United States Patent 11,702,646 (METHODS FOR MODULATING RNA SPLICING) - sequence listing, part 2

SEQ ID NO: 3307 - DNA, 10 bp, Artificial Sequence
  intronic recognition element for splicing modifier (REMS)
aggagtgggc

SEQ ID NO: 3308 - DNA, 10 bp, Artificial Sequence
  intronic recognition element for splicing modifier (REMS)
cggagtgggc

SEQ ID NO: 3309 - DNA, 10 bp, Artificial Sequence
  intronic recognition element for splicing modifier (REMS)
gggagtgggc

SEQ ID NO: 3310 - DNA, 10 bp, Artificial Sequence
  intronic recognition element for splicing modifier (REMS)
tggagtgggc

SEQ ID NO: 3311 - DNA, 10 bp, Artificial Sequence
  intronic recognition element for splicing modifier (REMS)
  misc_feature (2)..(2): n is a, c, g, or t
tngagtgggc

SEQ ID NO: 3312 - DNA, 10 bp, Artificial Sequence
  intronic recognition element for splicing modifier (REMS)
  misc_feature (1)..(1): n is a, c, g, or t
ntgagtgggc

SEQ ID NO: 3313 - DNA, 10 bp, Artificial Sequence
  intronic recognition element for splicing modifier (REMS)
atgagtgggc

SEQ ID NO: 3314 - DNA, 10 bp, Artificial Sequence
  intronic recognition element for splicing modifier (REMS)
ctgagtgggc

SEQ ID NO: 3315 - DNA, 10 bp, Artificial Sequence
  intronic recognition element for splicing modifier (REMS)
gtgagtgggc

SEQ ID NO: 3316 - DNA, 10 bp, Artificial Sequence
  intronic recognition element for splicing modifier (REMS)
ttgagtgggc

SEQ ID NO: 3317 - DNA, 10 bp, Artificial Sequence
  intronic recognition element for splicing modifier (REMS)
  misc_feature (2)..(2): n is a, c, g, or t
angagtgtgc

SEQ ID NO: 3318 - DNA, 10 bp, Artificial Sequence
  intronic recognition element for splicing modifier (REMS)
  misc_feature (1)..(1): n is a, c, g, or t
nagagtgtgc

SEQ ID NO: 3319 - DNA, 10 bp, Artificial Sequence
  intronic recognition element for splicing modifier (REMS)
aagagtgtgc

SEQ ID NO: 3320 - DNA, 10 bp, Artificial Sequence
  intronic recognition element for splicing modifier (REMS)
cagagtgtgc

SEQ ID NO: 3321 - DNA, 10 bp, Artificial Sequence
  intronic recognition element for splicing modifier (REMS)
gagagtgtgc

SEQ ID NO: 3322 - DNA, 10 bp, Artificial Sequence
  intronic recognition element for splicing modifier (REMS)
tagagtgtgc

SEQ ID NO: 3323 - DNA, 10 bp, Artificial Sequence
  intronic recognition element for splicing modifier (REMS)
  misc_feature (2)..(2): n is a, c, g, or t
cngagtgtgc

SEQ ID NO: 3324 - DNA, 10 bp, Artificial Sequence
  intronic recognition element for splicing modifier (REMS)
  misc_feature (1)..(1): n is a, c, g, or t
ncgagtgtgc

SEQ ID NO: 3325 - DNA, 10 bp, Artificial Sequence
  intronic recognition element for splicing modifier (REMS)
acgagtgtgc

SEQ ID NO: 3326 - DNA, 10 bp, Artificial Sequence
  intronic recognition element for splicing modifier (REMS)
ccgagtgtgc

SEQ ID NO: 3327 - DNA, 10 bp, Artificial Sequence
  intronic recognition element for splicing modifier (REMS)
gcgagtgtgc

SEQ ID NO: 3328 - DNA, 10 bp, Artificial Sequence
  intronic recognition element for splicing modifier (REMS)
tcgagtgtgc

SEQ ID NO: 3329 - DNA, 10 bp, Artificial Sequence
  intronic recognition element for splicing modifier (REMS)
  misc_feature (2)..(2): n is a, c, g, or t
gngagtgtgc

SEQ ID NO: 3330 - DNA, 10 bp, Artificial Sequence
  intronic recognition element for splicing modifier (REMS)
  misc_feature (1)..(1): n is a, c, g, or t
nggagtgtgc

SEQ ID NO: 3331 - DNA, 10 bp, Artificial Sequence
  intronic recognition element for splicing modifier (REMS)
aggagtgtgc

SEQ ID NO: 3332 - DNA, 10 bp, Artificial Sequence
  intronic recognition element for splicing modifier (REMS)
cggagtgtgc

SEQ ID NO: 3333 - DNA, 10 bp, Artificial Sequence
  intronic recognition element for splicing modifier (REMS)
gggagtgtgc

SEQ ID NO: 3334 - DNA, 10 bp, Artificial Sequence
  intronic recognition element for splicing modifier (REMS)
tggagtgtgc

SEQ ID NO: 3335 - DNA, 10 bp, Artificial Sequence
  intronic recognition element for splicing modifier (REMS)
  misc_feature (2)..(2): n is a, c, g, or t
tngagtgtgc

SEQ ID NO: 3336 - DNA, 10 bp, Artificial Sequence
  intronic recognition element for splicing modifier (REMS)
  misc_feature (1)..(1): n is a, c, g, or t
ntgagtgtgc

SEQ ID NO: 3337 - DNA, 10 bp, Artificial Sequence
  intronic recognition element for splicing modifier (REMS)
atgagtgtgc

SEQ ID NO: 3338 - DNA, 10 bp, Artificial Sequence
  intronic recognition element for splicing modifier (REMS)
ctgagtgtgc

SEQ ID NO: 3339 - DNA, 10 bp, Artificial Sequence
  intronic recognition element for splicing modifier (REMS)
gtgagtgtgc

SEQ ID NO: 3340 - DNA, 10 bp, Artificial Sequence
  intronic recognition element for splicing modifier (REMS)
ttgagtgtgc

SEQ ID NO: 3341 - DNA, 10 bp, Artificial Sequence
  intronic recognition element for splicing modifier (REMS)
  misc_feature (2)..(2): n is a, c, g, or t
angagtgagg

SEQ ID NO: 3342 - DNA, 10 bp, Artificial Sequence
  intronic recognition element for splicing modifier (REMS)
  misc_feature (1)..(1): n is a, c, g, or t
nagagtgagg

SEQ ID NO: 3343 - DNA, 10 bp, Artificial Sequence
  intronic recognition element for splicing modifier (REMS)
aagagtgagg

SEQ ID NO: 3344 - DNA, 10 bp, Artificial Sequence
  intronic recognition element for splicing modifier (REMS)
cagagtgagg

SEQ ID NO: 3345 - DNA, 10 bp, Artificial Sequence
  intronic recognition element for splicing modifier (REMS)
gagagtgagg

SEQ ID NO: 3346 - DNA, 10 bp, Artificial Sequence
  intronic recognition element for splicing modifier (REMS)
tagagtgagg

SEQ ID NO: 3347 - DNA, 10 bp, Artificial Sequence
  intronic recognition element for splicing modifier (REMS)
  misc_feature (2)..(2): n is a, c, g, or t
cngagtgagg

SEQ ID NO: 3348 - DNA, 10 bp, Artificial Sequence
  intronic recognition element for splicing modifier (REMS)
  misc_feature (1)..(1): n is a, c, g, or t
ncgagtgagg

SEQ ID NO: 3349 - DNA, 10 bp, Artificial Sequence
  intronic recognition element for splicing modifier (REMS)
acgagtgagg

SEQ ID NO: 3350 - DNA, 10 bp, Artificial Sequence
  intronic recognition element for splicing modifier (REMS)
ccgagtgagg

SEQ ID NO: 3351 - DNA, 10 bp, Artificial Sequence
  intronic recognition element for splicing modifier (REMS)
gcgagtgagg

SEQ ID NO: 3352 - DNA, 10 bp, Artificial Sequence
  intronic recognition element for splicing modifier (REMS)
tcgagtgagg

SEQ ID NO: 3353 - DNA, 10 bp, Artificial Sequence
  intronic recognition element for splicing modifier (REMS)
  misc_feature (2)..(2): n is a, c, g, or t
gngagtgagg

SEQ ID NO: 3354 - DNA, 10 bp, Artificial Sequence
  intronic recognition element for splicing modifier (REMS)
  misc_feature (1)..(1): n is a, c, g, or t
nggagtgagg

SEQ ID NO: 3355 - DNA, 10 bp, Artificial Sequence
  intronic recognition element for splicing modifier (REMS)
aggagtgagg

SEQ ID NO: 3356 - DNA, 10 bp, Artificial Sequence
  intronic recognition element for splicing modifier (REMS)
cggagtgagg

SEQ ID NO: 3357 - DNA, 10 bp, Artificial Sequence
  intronic recognition element for splicing modifier (REMS)
gggagtgagg

SEQ ID NO: 3358 - DNA, 10 bp, Artificial Sequence
  intronic recognition element for splicing modifier (REMS)
tggagtgagg

SEQ ID NO: 3359 - DNA, 10 bp, Artificial Sequence
  intronic recognition element for splicing modifier (REMS)
  misc_feature (2)..(2): n is a, c, g, or t
tngagtgagg

SEQ ID NO: 3360 - DNA, 10 bp, Artificial Sequence
  intronic recognition element for splicing modifier (REMS)
  misc_feature (1)..(1): n is a, c, g, or t
ntgagtgagg

SEQ ID NO: 3361 - DNA, 10 bp, Artificial Sequence
  intronic recognition element for splicing modifier (REMS)
atgagtgagg

SEQ ID NO: 3362 - DNA, 10 bp, Artificial Sequence
  intronic recognition element for splicing modifier (REMS)
ctgagtgagg

SEQ ID NO: 3363 - DNA, 10 bp, Artificial Sequence
  intronic recognition element for splicing modifier (REMS)
gtgagtgagg

SEQ ID NO: 3364 - DNA, 10 bp, Artificial Sequence
  intronic recognition element for splicing modifier (REMS)
ttgagtgagg

SEQ ID NO: 3365 - DNA, 10 bp, Artificial Sequence
  intronic recognition element for splicing modifier (REMS)
  misc_feature (2)..(2): n is a, c, g, or t
angagtgcgg

SEQ ID NO: 3366 - DNA, 10 bp, Artificial Sequence
  intronic recognition element for splicing modifier (REMS)
  misc_feature (1)..(1): n is a, c, g, or t
nagagtgcgg

SEQ ID NO: 3367 - DNA, 10 bp, Artificial Sequence
  intronic recognition element for splicing modifier (REMS)
aagagtgcgg

SEQ ID NO: 3368 - DNA, 10 bp, Artificial Sequence
  intronic recognition element for splicing modifier (REMS)
cagagtgcgg

SEQ ID NO: 3369 - DNA, 10 bp, Artificial Sequence
  intronic recognition element for splicing modifier (REMS)
gagagtgcgg

SEQ ID NO: 3370 - DNA, 10 bp, Artificial Sequence
  intronic recognition element for splicing modifier (REMS)
tagagtgcgg

SEQ ID NO: 3371 - DNA, 10 bp, Artificial Sequence
  intronic recognition element for splicing modifier (REMS)
  misc_feature (2)..(2): n is a, c, g, or t
cngagtgcgg

SEQ ID NO: 3372 - DNA, 10 bp, Artificial Sequence
  intronic recognition element for splicing modifier (REMS)
  misc_feature (1)..(1): n is a, c, g, or t
ncgagtgcgg

SEQ ID NO: 3373 - DNA, 10 bp, Artificial Sequence
  intronic recognition element for splicing modifier (REMS)
acgagtgcgg

SEQ ID NO: 3374 - DNA, 10 bp, Artificial Sequence
  intronic recognition element for splicing modifier (REMS)
ccgagtgcgg

SEQ ID NO: 3375 - DNA, 10 bp, Artificial Sequence
  intronic recognition element for splicing modifier (REMS)
gcgagtgcgg

SEQ ID NO: 3376 - DNA, 10 bp, Artificial Sequence
  intronic recognition element for splicing modifier (REMS)
tcgagtgcgg

SEQ ID NO: 3377 - DNA, 10 bp, Artificial Sequence
  intronic recognition element for splicing modifier (REMS)
  misc_feature (2)..(2): n is a, c, g, or t
gngagtgcgg

SEQ ID NO: 3378 - DNA, 10 bp, Artificial Sequence
  intronic recognition element for splicing modifier (REMS)
  misc_feature (1)..(1): n is a, c, g, or t
nggagtgcgg

SEQ ID NO: 3379 - DNA, 10 bp, Artificial Sequence
  intronic recognition element for splicing modifier (REMS)
aggagtgcgg

SEQ ID NO: 3380 - DNA, 10 bp, Artificial Sequence
  intronic recognition element for splicing modifier (REMS)
cggagtgcgg

SEQ ID NO: 3381 - DNA, 10 bp, Artificial Sequence
  intronic recognition element for splicing modifier (REMS)
gggagtgcgg

SEQ ID NO: 3382 - DNA, 10 bp, Artificial Sequence
  intronic recognition element for splicing modifier (REMS)
tggagtgcgg

SEQ ID NO: 3383 - DNA, 10 bp, Artificial Sequence
  intronic recognition element for splicing modifier (REMS)
  misc_feature (2)..(2): n is a, c, g, or t
tngagtgcgg

SEQ ID NO: 3384 - DNA, 10 bp, Artificial Sequence
  intronic recognition element for splicing modifier (REMS)
  misc_feature (1)..(1): n is a, c, g, or t
ntgagtgcgg

SEQ ID NO: 3385 - DNA, 10 bp, Artificial Sequence
  intronic recognition element for splicing modifier (REMS)
atgagtgcgg

SEQ ID NO: 3386 - DNA, 10 bp, Artificial Sequence
  intronic recognition element for splicing modifier (REMS)
ctgagtgcgg

SEQ ID NO: 3387 - DNA, 10 bp, Artificial Sequence
  intronic recognition element for splicing modifier (REMS)
gtgagtgcgg

SEQ ID NO: 3388 - DNA, 10 bp, Artificial Sequence
  intronic recognition element for splicing modifier (REMS)
ttgagtgcgg

SEQ ID NO: 3389 - DNA, 10 bp, Artificial Sequence
  intronic recognition element for splicing modifier (REMS)
  misc_feature (2)..(2): n is a, c, g, or t
angagtgggg

SEQ ID NO: 3390 - DNA, 10 bp, Artificial Sequence
  intronic recognition element for splicing modifier (REMS)
  misc_feature (1)..(1): n is a, c, g, or t
nagagtgggg

SEQ ID NO: 3391 - DNA, 10 bp, Artificial Sequence
  intronic recognition element for splicing modifier (REMS)
aagagtgggg

SEQ ID NO: 3392 - DNA, 10 bp, Artificial Sequence
  intronic recognition element for splicing modifier (REMS)
cagagtgggg

SEQ ID NO: 3393 - DNA, 10 bp, Artificial Sequence
  intronic recognition element for splicing modifier (REMS)
gagagtgggg

SEQ ID NO: 3394 - DNA, 10 bp, Artificial Sequence
  intronic recognition element for splicing modifier (REMS)
tagagtgggg

SEQ ID NO: 3395 - DNA, 10 bp, Artificial Sequence
  intronic recognition element for splicing modifier (REMS)
  misc_feature (2)..(2): n is a, c, g, or t
cngagtgggg

SEQ ID NO: 3396 - DNA, 10 bp, Artificial Sequence
  intronic recognition element for splicing modifier (REMS)
  misc_feature (1)..(1): n is a, c, g, or t
ncgagtgggg

SEQ ID NO: 3397 - DNA, 10 bp, Artificial Sequence
  intronic recognition element for splicing modifier (REMS)
acgagtgggg

SEQ ID NO: 3398 - DNA, 10 bp, Artificial Sequence
  intronic recognition element for splicing modifier (REMS)
ccgagtgggg

SEQ ID NO: 3399 - DNA, 10 bp, Artificial Sequence
  intronic recognition element for splicing modifier (REMS)
gcgagtgggg

SEQ ID NO: 3400 - DNA, 10 bp, Artificial Sequence
  intronic recognition element for splicing modifier (REMS)
tcgagtgggg

SEQ ID NO: 3401 - DNA, 10 bp, Artificial Sequence
  intronic recognition element for splicing modifier (REMS)
  misc_feature (2)..(2): n is a, c, g, or t
gngagtgggg

SEQ ID NO: 3402 - DNA, 10 bp, Artificial Sequence
  intronic recognition element for splicing modifier (REMS)
  misc_feature (1)..(1): n is a, c, g, or t
nggagtgggg

SEQ ID NO: 3403 - DNA, 10 bp, Artificial Sequence
  intronic recognition element for splicing modifier (REMS)
aggagtgggg

SEQ ID NO: 3404 - DNA, 10 bp, Artificial Sequence
  intronic recognition element for splicing modifier (REMS)
cggagtgggg

SEQ ID NO: 3405 - DNA, 10 bp, Artificial Sequence
  intronic recognition element for splicing modifier (REMS)
gggagtgggg

SEQ ID NO: 3406 - DNA, 10 bp, Artificial Sequence
  intronic recognition element for splicing modifier (REMS)
tggagtgggg

SEQ ID NO: 3407 - DNA, 10 bp, Artificial Sequence
  intronic recognition element for splicing modifier (REMS)
  misc_feature (2)..(2): n is a, c, g, or t
tngagtgggg

SEQ ID NO: 3408 - DNA, 10 bp, Artificial Sequence
  intronic recognition element for splicing modifier (REMS)
  misc_feature (1)..(1): n is a, c, g, or t
ntgagtgggg

SEQ ID NO: 3409 - DNA, 10 bp, Artificial Sequence
  intronic recognition element for splicing modifier (REMS)
atgagtgggg

SEQ ID NO: 3410 - DNA, 10 bp, Artificial Sequence
  intronic recognition element for splicing modifier (REMS)
ctgagtgggg

SEQ ID NO: 3411 - DNA, 10 bp, Artificial Sequence
  intronic recognition element for splicing modifier (REMS)
gtgagtgggg

SEQ ID NO: 3412 - DNA, 10 bp, Artificial Sequence
  intronic recognition element for splicing modifier (REMS)
ttgagtgggg

SEQ ID NO: 3413 - DNA, 10 bp, Artificial Sequence
  intronic recognition element for splicing modifier (REMS)
  misc_feature (2)..(2): n is a, c, g, or t
angagtgtgg

SEQ ID NO: 3414 - DNA, 10 bp, Artificial Sequence
  intronic recognition element for splicing modifier (REMS)
  misc_feature (1)..(1): n is a, c, g, or t
nagagtgtgg

SEQ ID NO: 3415 - DNA, 10 bp, Artificial Sequence
  intronic recognition element for splicing modifier (REMS)
aagagtgtgg

SEQ ID NO: 3416 - DNA, 10 bp, Artificial Sequence
  intronic recognition element for splicing modifier (REMS)
cagagtgtgg

SEQ ID NO: 3417 - DNA, 10 bp, Artificial Sequence
  intronic recognition element for splicing modifier (REMS)
gagagtgtgg

SEQ ID NO: 3418 - DNA, 10 bp, Artificial Sequence
  intronic recognition element for splicing modifier (REMS)
tagagtgtgg

SEQ ID NO: 3419 - DNA, 10 bp, Artificial Sequence
  intronic recognition element for splicing modifier (REMS)
  misc_feature (2)..(2): n is a, c, g, or t
cngagtgtgg

SEQ ID NO: 3420 - DNA, 10 bp, Artificial Sequence
  intronic recognition element for splicing modifier (REMS)
  misc_feature (1)..(1): n is a, c, g, or t
ncgagtgtgg

SEQ ID NO: 3421 - DNA, 10 bp, Artificial Sequence
  intronic recognition element for splicing modifier (REMS)
acgagtgtgg

SEQ ID NO: 3422 - DNA, 10 bp, Artificial Sequence
  intronic recognition element for splicing modifier (REMS)
ccgagtgtgg

SEQ ID NO: 3423 - DNA, 10 bp, Artificial Sequence
  intronic recognition element for splicing modifier (REMS)
gcgagtgtgg

SEQ ID NO: 3424 - DNA, 10 bp, Artificial Sequence
  intronic recognition element for splicing modifier (REMS)
tcgagtgtgg

SEQ ID NO: 3425 - DNA, 10 bp, Artificial Sequence
  intronic recognition element for splicing modifier (REMS)
  misc_feature (2)..(2): n is a, c, g, or t
gngagtgtgg

SEQ ID NO: 3426 - DNA, 10 bp, Artificial Sequence
  intronic recognition element for splicing modifier (REMS)
  misc_feature (1)..(1): n is a, c, g, or t
nggagtgtgg

SEQ ID NO: 3427 - DNA, 10 bp, Artificial Sequence
  intronic recognition element for splicing modifier (REMS)
aggagtgtgg

SEQ ID NO: 3428 - DNA, 10 bp, Artificial Sequence
  intronic recognition element for splicing modifier (REMS)
cggagtgtgg

SEQ ID NO: 3429 - DNA, 10 bp, Artificial Sequence
  intronic recognition element for splicing modifier (REMS)
gggagtgtgg

SEQ ID NO: 3430 - DNA, 10 bp, Artificial Sequence
  intronic recognition element for splicing modifier (REMS)
tggagtgtgg

SEQ ID NO: 3431 - DNA, 10 bp, Artificial Sequence
  intronic recognition element for splicing modifier (REMS)
  misc_feature (2)..(2): n is a, c, g, or t
tngagtgtgg

SEQ ID NO: 3432 - DNA, 10 bp, Artificial Sequence
  intronic recognition element for splicing modifier (REMS)
  misc_feature (1)..(1): n is a, c, g, or t
ntgagtgtgg

SEQ ID NO: 3433 - DNA, 10 bp, Artificial Sequence
  intronic recognition element for splicing modifier (REMS)
atgagtgtgg

SEQ ID NO: 3434 - DNA, 10 bp, Artificial Sequence
  intronic recognition element for splicing modifier (REMS)
ctgagtgtgg

SEQ ID NO: 3435 - DNA, 10 bp, Artificial Sequence
  intronic recognition element for splicing modifier (REMS)
gtgagtgtgg

SEQ ID NO: 3436 - DNA, 10 bp, Artificial Sequence
  intronic recognition element for splicing modifier (REMS)
ttgagtgtgg

SEQ ID NO: 3437 - DNA, 10 bp, Artificial Sequence
  intronic recognition element for splicing modifier (REMS)
  misc_feature (2)..(2): n is a, c, g, or t
angagtgagt

SEQ ID NO: 3438 - DNA, 10 bp, Artificial Sequence
  intronic recognition element for splicing modifier (REMS)
  misc_feature (1)..(1): n is a, c, g, or t
nagagtgagt

SEQ ID NO: 3439 - DNA, 10 bp, Artificial Sequence
  intronic recognition element for splicing modifier (REMS)
aagagtgagt

SEQ ID NO: 3440 - DNA, 10 bp, Artificial Sequence
  intronic recognition element for splicing modifier (REMS)
cagagtgagt

SEQ ID NO: 3441 - DNA, 10 bp, Artificial Sequence
  intronic recognition element for splicing modifier (REMS)
gagagtgagt

SEQ ID NO: 3442 - DNA, 10 bp, Artificial Sequence
  intronic recognition element for splicing modifier (REMS)
tagagtgagt

SEQ ID NO: 3443 - DNA, 10 bp, Artificial Sequence
  intronic recognition element for splicing modifier (REMS)
  misc_feature (2)..(2): n is a, c, g, or t
cngagtgagt

SEQ ID NO: 3444 - DNA, 10 bp, Artificial Sequence
  intronic recognition element for splicing modifier (REMS)
  misc_feature (1)..(1): n is a, c, g, or t
ncgagtgagt

SEQ ID NO: 3445 - DNA, 10 bp, Artificial Sequence
  intronic recognition element for splicing modifier (REMS)
acgagtgagt

SEQ ID NO: 3446 - DNA, 10 bp, Artificial Sequence
  intronic recognition element for splicing modifier (REMS)
ccgagtgagt

SEQ ID NO: 3447 - DNA, 10 bp, Artificial Sequence
  intronic recognition element for splicing modifier (REMS)
gcgagtgagt

SEQ ID NO: 3448 - DNA, 10 bp, Artificial Sequence
  intronic recognition element for splicing modifier (REMS)
tcgagtgagt

SEQ ID NO: 3449 - DNA, 10 bp, Artificial Sequence
  intronic recognition element for splicing modifier (REMS)
  misc_feature (2)..(2): n is a, c, g, or t
gngagtgagt

SEQ ID NO: 3450 - DNA, 10 bp, Artificial Sequence
  intronic recognition element for splicing modifier (REMS)
  misc_feature (1)..(1): n is a, c, g, or t
nggagtgagt

SEQ ID NO: 3451 - DNA, 10 bp, Artificial Sequence
  intronic recognition element for splicing modifier (REMS)
aggagtgagt

SEQ ID NO: 3452 - DNA, 10 bp, Artificial Sequence
  intronic recognition element for splicing modifier (REMS)
cggagtgagt

SEQ ID NO: 3453 - DNA, 10 bp, Artificial Sequence
  intronic recognition element for splicing modifier (REMS)
gggagtgagt

SEQ ID NO: 3454 - DNA, 10 bp, Artificial Sequence
  intronic recognition element for splicing modifier (REMS)
tggagtgagt

SEQ ID NO: 3455 - DNA, 10 bp, Artificial Sequence
  intronic recognition element for splicing modifier (REMS)
  misc_feature (2)..(2): n is a, c, g, or t
tngagtgagt

SEQ ID NO: 3456 - DNA, 10 bp, Artificial Sequence
  intronic recognition element for splicing modifier (REMS)
  misc_feature (1)..(1): n is a, c, g, or t
ntgagtgagt

SEQ ID NO: 3457 - DNA, 10 bp, Artificial Sequence
  intronic recognition element for splicing modifier (REMS)
atgagtgagt

SEQ ID NO: 3458 - DNA, 10 bp, Artificial Sequence
  intronic recognition element for splicing modifier (REMS)
ctgagtgagt

SEQ ID NO: 3459 - DNA, 10 bp, Artificial Sequence
  intronic recognition element for splicing modifier (REMS)
gtgagtgagt

SEQ ID NO: 3460 - DNA, 10 bp, Artificial Sequence
  intronic recognition element for splicing modifier (REMS)
ttgagtgagt

SEQ ID NO: 3461 - DNA, 10 bp, Artificial Sequence
  intronic recognition element for splicing modifier (REMS)
  misc_feature (2)..(2): n is a, c, g, or t
angagtgcgt

SEQ ID NO: 3462 - DNA, 10 bp, Artificial Sequence
  intronic recognition element for splicing modifier (REMS)
  misc_feature (1)..(1): n is a, c, g, or t
nagagtgcgt

SEQ ID NO: 3463 - DNA, 10 bp, Artificial Sequence
  intronic recognition element for splicing modifier (REMS)
aagagtgcgt

SEQ ID NO: 3464 - DNA, 10 bp, Artificial Sequence
  intronic recognition element for splicing modifier (REMS)
cagagtgcgt

SEQ ID NO: 3465 - DNA, 10 bp, Artificial Sequence
  intronic recognition element for splicing modifier (REMS)
gagagtgcgt

SEQ ID NO: 3466 - DNA, 10 bp, Artificial Sequence
  intronic recognition element for splicing modifier (REMS)
tagagtgcgt

SEQ ID NO: 3467 - DNA, 10 bp, Artificial Sequence
  intronic recognition element for splicing modifier (REMS)
  misc_feature (2)..(2): n is a, c, g, or t
cngagtgcgt

SEQ ID NO: 3468 - DNA, 10 bp, Artificial Sequence
  intronic recognition element for splicing modifier (REMS)
  misc_feature (1)..(1): n is a, c, g, or t
ncgagtgcgt

SEQ ID NO: 3469 - DNA, 10 bp, Artificial Sequence
  intronic recognition element for splicing modifier (REMS)
acgagtgcgt

SEQ ID NO: 3470 - DNA, 10 bp, Artificial Sequence
  intronic recognition element for splicing modifier (REMS)
ccgagtgcgt

SEQ ID NO: 3471 - DNA, 10 bp, Artificial Sequence
  intronic recognition element for splicing modifier (REMS)
gcgagtgcgt

SEQ ID NO: 3472 - DNA, 10 bp, Artificial Sequence
  intronic recognition element for splicing modifier (REMS)
tcgagtgcgt

SEQ ID NO: 3473 - DNA, 10 bp, Artificial Sequence
  intronic recognition element for splicing modifier (REMS)
  misc_feature (2)..(2): n is a, c, g, or t
gngagtgcgt

SEQ ID NO: 3474 - DNA, 10 bp, Artificial Sequence
  intronic recognition element for splicing modifier (REMS)
  misc_feature (1)..(1): n is a, c, g, or t
nggagtgcgt

SEQ ID NO: 3475 - DNA, 10 bp, Artificial Sequence
  intronic recognition element for splicing modifier (REMS)
aggagtgcgt

SEQ ID NO: 3476 - DNA, 10 bp, Artificial Sequence
  intronic recognition element for splicing modifier (REMS)
cggagtgcgt

SEQ ID NO: 3477 - DNA, 10 bp, Artificial Sequence
  intronic recognition element for splicing modifier (REMS)
gggagtgcgt

SEQ ID NO: 3478 - DNA, 10 bp, Artificial Sequence
  intronic recognition element for splicing modifier (REMS)
tggagtgcgt

SEQ ID NO: 3479 - DNA, 10 bp, Artificial Sequence
  intronic recognition element for splicing modifier (REMS)
  misc_feature (2)..(2): n is a, c, g, or t
tngagtgcgt

SEQ ID NO: 3480 - DNA, 10 bp, Artificial Sequence
  intronic recognition element for splicing modifier (REMS)
  misc_feature (1)..(1): n is a, c, g, or t
ntgagtgcgt

SEQ ID NO: 3481 - DNA, 10 bp, Artificial Sequence
  intronic recognition element for splicing modifier (REMS)
atgagtgcgt

SEQ ID NO: 3482 - DNA, 10 bp, Artificial Sequence
  intronic recognition element for splicing modifier (REMS)
ctgagtgcgt

SEQ ID NO: 3483 - DNA, 10 bp, Artificial Sequence
  intronic recognition element for splicing modifier (REMS)
gtgagtgcgt

SEQ ID NO: 3484 - DNA, 10 bp, Artificial Sequence
  intronic recognition element for splicing modifier (REMS)
ttgagtgcgt

SEQ ID NO: 3485 - DNA, 10 bp, Artificial Sequence
  intronic recognition element for splicing modifier (REMS)
  misc_feature (2)..(2): n is a, c, g, or t
angagtgggt

SEQ ID NO: 3486 - DNA, 10 bp, Artificial Sequence
  intronic recognition element for splicing modifier (REMS)
  misc_feature (1)..(1): n is a, c, g, or t
nagagtgggt

SEQ ID NO: 3487 - DNA, 10 bp, Artificial Sequence
  intronic recognition element for splicing modifier (REMS)
aagagtgggt

SEQ ID NO: 3488 - DNA, 10 bp, Artificial Sequence
  intronic recognition element for splicing modifier (REMS)
cagagtgggt

SEQ ID NO: 3489 - DNA, 10 bp, Artificial Sequence
  intronic recognition element for splicing modifier (REMS)
gagagtgggt

SEQ ID NO: 3490 - DNA, 10 bp, Artificial Sequence
  intronic recognition element for splicing modifier (REMS)
tagagtgggt

SEQ ID NO: 3491 - DNA, 10 bp, Artificial Sequence
  intronic recognition element for splicing modifier (REMS)
  misc_feature (2)..(2): n is a, c, g, or t
cngagtgggt

SEQ ID NO: 3492 - DNA, 10 bp, Artificial Sequence
  intronic recognition element for splicing modifier (REMS)
  misc_feature (1)..(1): n is a, c, g, or t
ncgagtgggt

SEQ ID NO: 3493 - DNA, 10 bp, Artificial Sequence
  intronic recognition element for splicing modifier (REMS)
acgagtgggt

SEQ ID NO: 3494 - DNA, 10 bp, Artificial Sequence
  intronic recognition element for splicing modifier (REMS)
ccgagtgggt

SEQ ID NO: 3495 - DNA, 10 bp, Artificial Sequence
  intronic recognition element for splicing modifier (REMS)
gcgagtgggt

SEQ ID NO: 3496 - DNA, 10 bp, Artificial Sequence
  intronic recognition element for splicing modifier (REMS)
tcgagtgggt

SEQ ID NO: 3497 - DNA, 10 bp, Artificial Sequence
  intronic recognition element for splicing modifier (REMS)
  misc_feature (2)..(2): n is a, c, g, or t
gngagtgggt

SEQ ID NO: 3498 - DNA, 10 bp, Artificial Sequence
  intronic recognition element for splicing modifier (REMS)
  misc_feature (1)..(1): n is a, c, g, or t
nggagtgggt

SEQ ID NO: 3499 - DNA, 10 bp, Artificial Sequence
  intronic recognition element for splicing modifier (REMS)
aggagtgggt

SEQ ID NO: 3500 - DNA, 10 bp, Artificial Sequence
  intronic recognition element for splicing modifier (REMS)
cggagtgggt

SEQ ID NO: 3501 - DNA, 10 bp, Artificial Sequence
  intronic recognition element for splicing modifier (REMS)
gggagtgggt

SEQ ID NO: 3502 - DNA, 10 bp, Artificial Sequence
  intronic recognition element for splicing modifier (REMS)
tggagtgggt

SEQ ID NO: 3503 - DNA, 10 bp, Artificial Sequence
  intronic recognition element for splicing modifier (REMS)
  misc_feature (2)..(2): n is a, c, g, or t
tngagtgggt

SEQ ID NO: 3504 - DNA, 10 bp, Artificial Sequence
  intronic recognition element for splicing modifier (REMS)
  misc_feature (1)..(1): n is a, c, g, or t
ntgagtgggt

SEQ ID NO: 3505 - DNA, 10 bp, Artificial Sequence
  intronic recognition element for splicing modifier (REMS)
atgagtgggt

SEQ ID NO: 3506 - DNA, 10 bp, Artificial Sequence
  intronic recognition element for splicing modifier (REMS)
ctgagtgggt

SEQ ID NO: 3507 - DNA, 10 bp, Artificial Sequence
  intronic recognition element for splicing modifier (REMS)
gtgagtgggt

SEQ ID NO: 3508 - DNA, 10 bp, Artificial Sequence
  intronic recognition element for splicing modifier (REMS)
ttgagtgggt

SEQ ID NO: 3509 - DNA, 10 bp, Artificial Sequence
  intronic recognition element for splicing modifier (REMS)
  misc_feature (2)..(2): n is a, c, g, or t
angagtgtgt

SEQ ID NO: 3510 - DNA, 10 bp, Artificial Sequence
  intronic recognition element for splicing modifier (REMS)
  misc_feature (1)..(1): n is a, c, g, or t
nagagtgtgt

SEQ ID NO: 3511 - DNA, 10 bp, Artificial Sequence
  intronic recognition element for splicing modifier (REMS)
aagagtgtgt

SEQ ID NO: 3512 - DNA, 10 bp, Artificial Sequence
  intronic recognition element for splicing modifier (REMS)
cagagtgtgt

SEQ ID NO: 3513 - DNA, 10 bp, Artificial Sequence
  intronic recognition element for splicing modifier (REMS)
gagagtgtgt

SEQ ID NO: 3514 - DNA, 10 bp, Artificial Sequence
  intronic recognition element for splicing modifier (REMS)
tagagtgtgt

SEQ ID NO: 3515 - DNA, 10 bp, Artificial Sequence
  intronic recognition element for splicing modifier (REMS)
  misc_feature (2)..(2): n is a, c, g, or t
cngagtgtgt

SEQ ID NO: 3516 - DNA, 10 bp, Artificial Sequence
  intronic recognition element for splicing modifier (REMS)
  misc_feature (1)..(1): n is a, c, g, or t
ncgagtgtgt

SEQ ID NO: 3517 - DNA, 10 bp, Artificial Sequence
  intronic recognition element for splicing modifier (REMS)
acgagtgtgt

SEQ ID NO: 3518 - DNA, 10 bp, Artificial Sequence
  intronic recognition element for splicing modifier (REMS)
ccgagtgtgt

SEQ ID NO: 3519 - DNA, 10 bp, Artificial Sequence
  intronic recognition element for splicing modifier (REMS)
gcgagtgtgt

SEQ ID NO: 3520 - DNA, 10 bp, Artificial Sequence
  intronic recognition element for splicing modifier (REMS)
tcgagtgtgt

SEQ ID NO: 3521 - DNA, 10 bp, Artificial Sequence
  intronic recognition element for splicing modifier (REMS)
  misc_feature (2)..(2): n is a, c, g, or t
gngagtgtgt

SEQ ID NO: 3522 - DNA, 10 bp, Artificial Sequence
  intronic recognition element for splicing modifier (REMS)
  misc_feature (1)..(1): n is a, c, g, or t
nggagtgtgt

SEQ ID NO: 3523 - DNA, 10 bp, Artificial Sequence
  intronic recognition element for splicing modifier (REMS)
aggagtgtgt

SEQ ID NO: 3524 - DNA, 10 bp, Artificial Sequence
  intronic recognition element for splicing modifier (REMS)
cggagtgtgt

SEQ ID NO: 3525 - DNA, 10 bp, Artificial Sequence
  intronic recognition element for splicing modifier (REMS)
gggagtgtgt

SEQ ID NO: 3526 - DNA, 10 bp, Artificial Sequence
  intronic recognition element for splicing modifier (REMS)
tggagtgtgt

SEQ ID NO: 3527 - DNA, 10 bp, Artificial Sequence
  intronic recognition element for splicing modifier (REMS)
  misc_feature (2)..(2): n is a, c, g, or t
tngagtgtgt

SEQ ID NO: 3528 - DNA, 10 bp, Artificial Sequence
  intronic recognition element for splicing modifier (REMS)
  misc_feature (1)..(1): n is a, c, g, or t
ntgagtgtgt

SEQ ID NO: 3529 - DNA, 10 bp, Artificial Sequence
  intronic recognition element for splicing modifier (REMS)
atgagtgtgt

SEQ ID NO: 3530 - DNA, 10 bp, Artificial Sequence
  intronic recognition element for splicing modifier (REMS)
ctgagtgtgt

SEQ ID NO: 3531 - DNA, 10 bp, Artificial Sequence
  intronic recognition element for splicing modifier (REMS)
gtgagtgtgt

SEQ ID NO: 3532 - DNA, 10 bp, Artificial Sequence
  intronic recognition element for splicing modifier (REMS)
ttgagtgtgt

SEQ ID NO: 3533 - DNA, 10 bp, Artificial Sequence
  intronic recognition element for splicing modifier (REMS)
  misc_feature (2)..(2): n is a, c, g, or t
  misc_feature (8)..(8): n is a, c, g, or t
angagtgnga

SEQ ID NO: 3534 - DNA, 10 bp, Artificial Sequence
  intronic recognition element for splicing modifier (REMS)
  misc_feature (1)..(1): n is a, c, g, or t
  misc_feature (8)..(8): n is a, c, g, or t
nagagtgnga

SEQ ID NO: 3535 - DNA, 10 bp, Artificial Sequence
  intronic recognition element for splicing modifier (REMS)
  misc_feature (8)..(8): n is a, c, g, or t
aagagtgnga

SEQ ID NO: 3536 - DNA, 10 bp, Artificial Sequence
  intronic recognition element for splicing modifier (REMS)
  misc_feature (8)..(8): n is a, c, g, or t
cagagtgnga

SEQ ID NO: 3537 - DNA, 10 bp, Artificial Sequence
  intronic recognition element for splicing modifier (REMS)
  misc_feature (8)..(8): n is a, c, g, or t
gagagtgnga

SEQ ID NO: 3538 - DNA, 10 bp, Artificial Sequence
  intronic recognition element for splicing modifier (REMS)
  misc_feature (8)..(8): n is a, c, g, or t
tagagtgnga

SEQ ID NO: 3539 - DNA, 10 bp, Artificial Sequence
  intronic recognition element for splicing modifier (REMS)
  misc_feature (2)..(2): n is a, c, g, or t
  misc_feature (8)..(8): n is a, c, g, or t
cngagtgnga

SEQ ID NO: 3540 - DNA, 10 bp, Artificial Sequence
  intronic recognition element for splicing modifier (REMS)
  misc_feature (1)..(1): n is a, c, g, or t
  misc_feature (8)..(8): n is a, c, g, or t
ncgagtgnga

SEQ ID NO: 3541 - DNA, 10 bp, Artificial Sequence
  intronic recognition element for splicing modifier (REMS)
  misc_feature (8)..(8): n is a, c, g, or t
acgagtgnga

SEQ ID NO: 3542 - DNA, 10 bp, Artificial Sequence
  intronic recognition element for splicing modifier (REMS)
  misc_feature (8)..(8): n is a, c, g, or t
ccgagtgnga

SEQ ID NO: 3543 - DNA, 10 bp, Artificial Sequence
  intronic recognition element for splicing modifier (REMS)
  misc_feature (8)..(8): n is a, c, g, or t
gcgagtgnga

SEQ ID NO: 3544 - DNA, 10 bp, Artificial Sequence
  intronic recognition element for splicing modifier (REMS)
  misc_feature (8)..(8): n is a, c, g, or t
tcgagtgnga

SEQ ID NO: 3545 - DNA, 10 bp, Artificial Sequence
  intronic recognition element for splicing modifier (REMS)
  misc_feature (2)..(2): n is a, c, g, or t
  misc_feature (8)..(8): n is a, c, g, or t
gngagtgnga

SEQ ID NO: 3546 - DNA, 10 bp, Artificial Sequence
  intronic recognition element for splicing modifier (REMS)
  misc_feature (1)..(1): n is a, c, g, or t
  misc_feature (8)..(8): n is a, c, g, or t
nggagtgnga

SEQ ID NO: 3547 - DNA, 10 bp, Artificial Sequence
  intronic recognition element for splicing modifier (REMS)
  misc_feature (8)..(8): n is a, c, g, or t
aggagtgnga

SEQ ID NO: 3548 - DNA, 10 bp, Artificial Sequence
  intronic recognition element for splicing modifier (REMS)
  misc_feature (8)..(8): n is a, c, g, or t
cggagtgnga

SEQ ID NO: 3549 - DNA, 10 bp, Artificial Sequence
  intronic recognition element for splicing modifier (REMS)
  misc_feature (8)..(8): n is a, c, g, or t
gggagtgnga

SEQ ID NO: 3550 - DNA, 10 bp, Artificial Sequence
  intronic recognition element for splicing modifier (REMS)
  misc_feature (8)..(8): n is a, c, g, or t
tggagtgnga

SEQ ID NO: 3551 - DNA, 10 bp, Artificial Sequence
  intronic recognition element for splicing modifier (REMS)
  misc_feature (2)..(2): n is a, c, g, or t
  misc_feature (8)..(8): n is a, c, g, or t
tngagtgnga

SEQ ID NO: 3552 - DNA, 10 bp, Artificial Sequence
  intronic recognition element for splicing modifier (REMS)
  misc_feature (1)..(1): n is a, c, g, or t
  misc_feature (8)..(8): n is a, c, g, or t
ntgagtgnga

SEQ ID NO: 3553 - DNA, 10 bp, Artificial Sequence
  intronic recognition element for splicing modifier (REMS)
  misc_feature (8)..(8): n is a, c, g, or t
atgagtgnga

SEQ ID NO: 3554 - DNA, 10 bp, Artificial Sequence
  intronic recognition element for splicing modifier (REMS)
  misc_feature (8)..(8): n is a, c, g, or t
ctgagtgnga

SEQ ID NO: 3555 - DNA, 10 bp, Artificial Sequence
  intronic recognition element for splicing modifier (REMS)
  misc_feature (8)..(8): n is a, c, g, or t
gtgagtgnga

SEQ ID NO: 3556 - DNA, 10 bp, Artificial Sequence
  intronic recognition element for splicing modifier (REMS)
  misc_feature (8)..(8): n is a, c, g, or t
ttgagtgnga

SEQ ID NO: 3557 - DNA, 10 bp, Artificial Sequence
  intronic recognition element for splicing modifier (REMS)
  misc_feature (2)..(2): n is a, c, g, or t
  misc_feature (8)..(8): n is a, c, g, or t
angagtgngc

SEQ ID NO: 3558 - DNA, 10 bp, Artificial Sequence
  intronic recognition element for splicing modifier (REMS)
  misc_feature (1)..(1): n is a, c, g, or t
  misc_feature (8)..(8): n is a, c, g, or t
nagagtgngc

SEQ ID NO: 3559 - DNA, 10 bp, Artificial Sequence
  intronic recognition element for splicing modifier (REMS)
  misc_feature (8)..(8): n is a, c, g, or t
aagagtgngc

SEQ ID NO: 3560 - DNA, 10 bp, Artificial Sequence
  intronic recognition element for splicing modifier (REMS)
  misc_feature (8)..(8): n is a, c, g, or t
cagagtgngc

SEQ ID NO: 3561 - DNA, 10 bp, Artificial Sequence
  intronic recognition element for splicing modifier (REMS)
  misc_feature (8)..(8): n is a, c, g, or t
gagagtgngc

SEQ ID NO: 3562 - DNA, 10 bp, Artificial Sequence
  intronic recognition element for splicing modifier (REMS)
  misc_feature (8)..(8): n is a, c, g, or t
tagagtgngc

SEQ ID NO: 3563 - DNA, 10 bp, Artificial Sequence
  intronic recognition element for splicing modifier (REMS)
  misc_feature (2)..(2): n is a, c, g, or t
  misc_feature (8)..(8): n is a, c, g, or t
cngagtgngc

SEQ ID NO: 3564 - DNA, 10 bp, Artificial Sequence
  intronic recognition element for splicing modifier (REMS)
  misc_feature (1)..(1): n is a, c, g, or t
  misc_feature (8)..(8): n is a, c, g, or t
ncgagtgngc

SEQ ID NO: 3565 - DNA, 10 bp, Artificial Sequence
  intronic recognition element for splicing modifier (REMS)
  misc_feature (8)..(8): n is a, c, g, or t
acgagtgngc

SEQ ID NO: 3566 - DNA, 10 bp, Artificial Sequence
  intronic recognition element for splicing modifier (REMS)
  misc_feature (8)..(8): n is a, c, g, or t
ccgagtgngc

SEQ ID NO: 3567 - DNA, 10 bp, Artificial Sequence
  intronic recognition element for splicing modifier (REMS)
  misc_feature (8)..(8): n is a, c, g, or t
gcgagtgngc

SEQ ID NO: 3568 - DNA, 10 bp, Artificial Sequence
  intronic recognition element for splicing modifier (REMS)
  misc_feature (8)..(8): n is a, c, g, or t
tcgagtgngc

SEQ ID NO: 3569 - DNA, 10 bp, Artificial Sequence
  intronic recognition element for splicing modifier (REMS)
  misc_feature (2)..(2): n is a, c, g, or t
  misc_feature (8)..(8): n is a, c, g, or t
gngagtgngc

SEQ ID NO: 3570 - DNA, 10 bp, Artificial Sequence
  intronic recognition element for splicing modifier (REMS)
  misc_feature (1)..(1): n is a, c, g, or t
  misc_feature (8)..(8): n is a, c, g, or t
nggagtgngc

SEQ ID NO: 3571 - DNA, 10 bp, Artificial Sequence
  intronic recognition element for splicing modifier (REMS)
  misc_feature (8)..(8): n is a, c, g, or t
aggagtgngc

SEQ ID NO: 3572 - DNA, 10 bp, Artificial Sequence
  intronic recognition element for splicing modifier (REMS)
  misc_feature (8)..(8): n is a, c, g, or t
cggagtgngc

SEQ ID NO: 3573 - DNA, 10 bp, Artificial Sequence
  intronic recognition element for splicing modifier (REMS)
  misc_feature (8)..(8): n is a, c, g, or t
gggagtgngc

SEQ ID NO: 3574 - DNA, 10 bp, Artificial Sequence
  intronic recognition element for splicing modifier (REMS)
  misc_feature (8)..(8): n is a, c, g, or t
tggagtgngc

SEQ ID NO: 3575 - DNA, 10 bp, Artificial Sequence
  intronic recognition element for splicing modifier (REMS)
  misc_feature (2)..(2): n is a, c, g, or t
  misc_feature (8)..(8): n is a, c, g, or t
tngagtgngc

SEQ ID NO: 3576 - DNA, 10 bp, Artificial Sequence
  intronic recognition element for splicing modifier (REMS)
  misc_feature (1)..(1): n is a, c, g, or t
  misc_feature (8)..(8): n is a, c, g, or t
ntgagtgngc

SEQ ID NO: 3577 - DNA, 10 bp, Artificial Sequence
  intronic recognition element for splicing modifier (REMS)
  misc_feature (8)..(8): n is a, c, g, or t
atgagtgngc

SEQ ID NO: 3578 - DNA, 10 bp, Artificial Sequence
  intronic recognition element for splicing modifier (REMS)
  misc_feature (8)..(8): n is a, c, g, or t
ctgagtgngc

SEQ ID NO: 3579 - DNA, 10 bp, Artificial Sequence
  intronic recognition element for splicing modifier (REMS)
  misc_feature (8)..(8): n is a, c, g, or t
gtgagtgngc

SEQ ID NO: 3580 - DNA, 10 bp, Artificial Sequence
  intronic recognition element for splicing modifier (REMS)
  misc_feature (8)..(8): n is a, c, g, or t
ttgagtgngc

SEQ ID NO: 3581 - DNA, 10 bp, Artificial Sequence
  intronic recognition element for splicing modifier (REMS)
  misc_feature (2)..(2): n is a, c, g, or t
  misc_feature (8)..(8): n is a, c, g, or t
angagtgngg

SEQ ID NO: 3582 - DNA, 10 bp, Artificial Sequence
  intronic recognition element for splicing modifier (REMS)
  misc_feature (1)..(1): n is a, c, g, or t
  misc_feature (8)..(8): n is a, c, g, or t
nagagtgngg

SEQ ID NO: 3583 - DNA, 10 bp, Artificial Sequence
  intronic recognition element for splicing modifier (REMS)
  misc_feature (8)..(8): n is a, c, g, or t
aagagtgngg

SEQ ID NO: 3584 - DNA, 10 bp, Artificial Sequence
  intronic recognition element for splicing modifier (REMS)
  misc_feature (8)..(8): n is a, c, g, or t
cagagtgngg

SEQ ID NO: 3585 - DNA, 10 bp, Artificial Sequence
  intronic recognition element for splicing modifier (REMS)
  misc_feature (8)..(8): n is a, c, g, or t
gagagtgngg

SEQ ID NO: 3586 - DNA, 10 bp, Artificial Sequence
  intronic recognition element for splicing modifier (REMS)
  misc_feature (8)..(8): n is a, c, g, or t
tagagtgngg

SEQ ID NO: 3587 - DNA, 10 bp, Artificial Sequence
  intronic recognition element for splicing modifier (REMS)
  misc_feature (2)..(2): n is a, c, g, or t
  misc_feature (8)..(8): n is a, c, g, or t
cngagtgngg

SEQ ID NO: 3588 - DNA, 10 bp, Artificial Sequence
  intronic recognition element for splicing modifier (REMS)
  misc_feature (1)..(1): n is a, c, g, or t
  misc_feature (8)..(8): n is a, c, g, or t
ncgagtgngg

SEQ ID NO: 3589 - DNA, 10 bp, Artificial Sequence
  intronic recognition element for splicing modifier (REMS)
  misc_feature (8)..(8): n is a, c, g, or t
acgagtgngg

SEQ ID NO: 3590 - DNA, 10 bp, Artificial Sequence
  intronic recognition element for splicing modifier (REMS)
  misc_feature (8)..(8): n is a, c, g, or t
ccgagtgngg

SEQ ID NO: 3591 - DNA, 10 bp, Artificial Sequence
  intronic recognition element for splicing modifier (REMS)
  misc_feature (8)..(8): n is a, c, g, or t
gcgagtgngg

SEQ ID NO: 3592 - DNA, 10 bp, Artificial Sequence
  intronic recognition element for splicing modifier (REMS)
  misc_feature (8)..(8): n is a, c, g, or t
tcgagtgngg

SEQ ID NO: 3593 - DNA, 10 bp, Artificial Sequence
  intronic recognition element for splicing modifier (REMS)
  misc_feature (2)..(2): n is a, c, g, or t
  misc_feature (8)..(8): n is a, c, g, or t
gngagtgngg

SEQ ID NO: 3594 - DNA, 10 bp, Artificial Sequence
  intronic recognition element for splicing modifier (REMS)
  misc_feature (1)..(1): n is a, c, g, or t
  misc_feature (8)..(8): n is a, c, g, or t
nggagtgngg

SEQ ID NO: 3595 - DNA, 10 bp, Artificial Sequence
  intronic recognition element for splicing modifier (REMS)
  misc_feature (8)..(8): n is a, c, g, or t
aggagtgngg

SEQ ID NO: 3596 - DNA, 10 bp, Artificial Sequence
  intronic recognition element for splicing modifier (REMS)
  misc_feature (8)..(8): n is a, c, g, or t
cggagtgngg

SEQ ID NO: 3597 - DNA, 10 bp, Artificial Sequence
  intronic recognition element for splicing modifier (REMS)
  misc_feature (8)..(8): n is a, c, g, or t
gggagtgngg

SEQ ID NO: 3598 - DNA, 10 bp, Artificial Sequence
  intronic recognition element for splicing modifier (REMS)
  misc_feature (8)..(8): n is a, c, g, or t
tggagtgngg

SEQ ID NO: 3599 - DNA, 10 bp, Artificial Sequence
  intronic recognition element for splicing modifier (REMS)
  misc_feature (2)..(2): n is a, c, g, or t
  misc_feature (8)..(8): n is a, c, g, or t
tngagtgngg

SEQ ID NO: 3600 - DNA, 10 bp, Artificial Sequence
  intronic recognition element for splicing modifier (REMS)
  misc_feature (1)..(1): n is a, c, g, or t
  misc_feature (8)..(8): n is a, c, g, or t
ntgagtgngg

SEQ ID NO: 3601 - DNA, 10 bp, Artificial Sequence
  intronic recognition element for splicing modifier (REMS)
  misc_feature (8)..(8): n is a, c, g, or t
atgagtgngg

SEQ ID NO: 3602 - DNA, 10 bp, Artificial Sequence
  intronic recognition element for splicing modifier (REMS)
  misc_feature (8)..(8): n is a, c, g, or t
ctgagtgngg

SEQ ID NO: 3603 - DNA, 10 bp, Artificial Sequence
  intronic recognition element for splicing modifier (REMS)
  misc_feature (8)..(8): n is a, c, g, or t
gtgagtgngg

SEQ ID NO: 3604 - DNA, 10 bp, Artificial Sequence
  intronic recognition element for splicing modifier (REMS)
  misc_feature (8)..(8): n is a, c, g, or t
ttgagtgngg

SEQ ID NO: 3605 - DNA, 10 bp, Artificial Sequence
  intronic recognition element for splicing modifier (REMS)
  misc_feature (2)..(2): n is a, c, g, or t
  misc_feature (8)..(8): n is a, c, g, or t
angagtgngt

SEQ ID NO: 3606 - DNA, 10 bp, Artificial Sequence
  intronic recognition element for splicing modifier (REMS)
  misc_feature (1)..(1): n is a, c, g, or t
  misc_feature (8)..(8): n is a, c, g, or t
nagagtgngt

SEQ ID NO: 3607 - DNA, 10 bp, Artificial Sequence
  intronic recognition element for splicing modifier (REMS)
  misc_feature (8)..(8): n is a, c, g, or t
aagagtgngt

SEQ ID NO: 3608 - DNA, 10 bp, Artificial Sequence
  intronic recognition element for splicing modifier (REMS)
  misc_feature (8)..(8): n is a, c, g, or t
cagagtgngt

SEQ ID NO: 3609 - DNA, 10 bp, Artificial Sequence
  intronic recognition element for splicing modifier (REMS)
  misc_feature (8)..(8): n is a, c, g, or t
gagagtgngt

SEQ ID NO: 3610 - DNA, 10 bp, Artificial Sequence
  intronic recognition element for splicing modifier (REMS)
  misc_feature (8)..(8): n is a, c, g, or t
tagagtgngt

SEQ ID NO: 3611 - DNA, 10 bp, Artificial Sequence
  intronic recognition element for splicing modifier (REMS)
  misc_feature (2)..(2): n is a, c, g, or t
  misc_feature (8)..(8): n is a, c, g, or t
cngagtgngt

SEQ ID NO: 3612 - DNA, 10 bp, Artificial Sequence
  intronic recognition element for splicing modifier (REMS)
  misc_feature (1)..(1): n is a, c, g, or t
  misc_feature (8)..(8): n is a, c, g, or t
ncgagtgngt

SEQ ID NO: 3613 - DNA, 10 bp, Artificial Sequence
  intronic recognition element for splicing modifier (REMS)
  misc_feature (8)..(8): n is a, c, g, or t
acgagtgngt

SEQ ID NO: 3614 - DNA, 10 bp, Artificial Sequence
  intronic recognition element for splicing modifier (REMS)
  misc_feature (8)..(8): n is a, c, g, or t
ccgagtgngt

SEQ ID NO: 3615 - DNA, 10 bp, Artificial Sequence
  intronic recognition element for splicing modifier (REMS)
  misc_feature (8)..(8): n is a, c, g, or t
gcgagtgngt

SEQ ID NO: 3616 - DNA, 10 bp, Artificial Sequence
  intronic recognition element for splicing modifier (REMS)
  misc_feature (8)..(8): n is a, c, g, or t
tcgagtgngt

SEQ ID NO: 3617 - DNA, 10 bp, Artificial Sequence
  intronic recognition element for splicing modifier (REMS)
  misc_feature (2)..(2): n is a, c, g, or t
  misc_feature (8)..(8): n is a, c, g, or t
gngagtgngt

SEQ ID NO: 3618 - DNA, 10 bp, Artificial Sequence
  intronic recognition element for splicing modifier (REMS)
  misc_feature (1)..(1): n is a, c, g, or t
  misc_feature (8)..(8): n is a, c, g, or t
nggagtgngt

SEQ ID NO: 3619 - DNA, 10 bp, Artificial Sequence
  intronic recognition element for splicing modifier (REMS)
  misc_feature (8)..(8): n is a, c, g, or t
aggagtgngt

SEQ ID NO: 3620 - DNA, 10 bp, Artificial Sequence
  intronic recognition element for splicing modifier (REMS)
  misc_feature (8)..(8): n is a, c, g, or t
cggagtgngt

SEQ ID NO: 3621 - DNA, 10 bp, Artificial Sequence
  intronic recognition element for splicing modifier (REMS)
  misc_feature (8)..(8): n is a, c, g, or t
gggagtgngt

SEQ ID NO: 3622 - DNA, 10 bp, Artificial Sequence
  intronic recognition element for splicing modifier (REMS)
  misc_feature (8)..(8): n is a, c, g, or t
tggagtgngt

SEQ ID NO: 3623 - DNA, 10 bp, Artificial Sequence
  intronic recognition element for splicing modifier (REMS)
  misc_feature (2)..(2): n is a, c, g, or t
  misc_feature (8)..(8): n is a, c, g, or t
tngagtgngt

SEQ ID NO: 3624 - DNA, 10 bp, Artificial Sequence
  intronic recognition element for splicing modifier (REMS)
  misc_feature (1)..(1): n is a, c, g, or t
  misc_feature (8)..(8): n is a, c, g, or t
ntgagtgngt

SEQ ID NO: 3625 - DNA, 10 bp, Artificial Sequence
  intronic recognition element for splicing modifier (REMS)
  misc_feature (8)..(8): n is a, c, g, or t
atgagtgngt

SEQ ID NO: 3626 - DNA, 10 bp, Artificial Sequence
  intronic recognition element for splicing modifier (REMS)
  misc_feature (8)..(8): n is a, c, g, or t
ctgagtgngt

SEQ ID NO: 3627 - DNA, 10 bp, Artificial Sequence
  intronic recognition element for splicing modifier (REMS)
  misc_feature (8)..(8): n is a, c, g, or t
gtgagtgngt

SEQ ID NO: 3628 - DNA, 10 bp, Artificial Sequence
  intronic recognition element for splicing modifier (REMS)
  misc_feature (8)..(8): n is a, c, g, or t
ttgagtgngt

SEQ ID NO: 3629 - DNA, 20 bp, Artificial Sequence
  forward primer ABCB_54-73
gccggcggctcctgttttac

SEQ ID NO: 3630 - DNA, 20 bp, Artificial Sequence
  forward primer ANXA_101-120
agtcgctgtaccacgacatc

SEQ ID NO: 3631 - DNA, 20 bp, Artificial Sequence
  forward primer ARL1_87-106-1a-KE
gctgccggatgtctgatctc

SEQ ID NO: 3632 - DNA, 21 bp, Artificial Sequence
  forward primer DECA_23-43-KE
tgctgtaccttgcagtgttcc

SEQ ID NO: 3633 - DNA, 20 bp, Artificial Sequence
  forward primer DHFR_5-24
ccatgaatcacccaggccat

SEQ ID NO: 3634 - DNA, 21 bp, Artificial Sequence
  forward primer FAIM_197-217-KE
gtgaaacctaccccagagcct

SEQ ID NO: 3635 - DNA, 21 bp, Artificial Sequence
  forward primer GXYL_57-77
ggaagcaattgccaagaagca

SEQ ID NO: 3636 - DNA, 20 bp, Artificial Sequence
  forward primer HTT_E49_For
tgcccagtcatttgcacctt

SEQ ID NO: 3637 - DNA, 20 bp, Artificial Sequence
  forward primer MADD_137-156-KE
tgccacaggaaagggtccta

SEQ ID NO: 3638 - DNA, 20 bp, Artificial Sequence
  forward primer MEMO_37-56
tggagctctgagtgagtcaa

SEQ ID NO: 3639 - DNA, 21 bp, Artificial Sequence
  forward primer OXCT_55-75-KE
ggcctgacagtggatgacgta

SEQ ID NO: 3640 - DNA, 20 bp, Artificial Sequence
  forward primer PAPD_46-65-KE
cccggagcagtgatggtgat

SEQ ID NO: 3641 - DNA, 20 bp, Artificial Sequence
  forward primer PDXD_23-42
tgtgccgtgtaccctgtaac

SEQ ID NO: 3642 - DNA, 24 bp, Artificial Sequence
  forward primer PMS1_104-127-KE
tctcctcatgagctttggtatcct

SEQ ID NO: 3643 - DNA, 24 bp, Artificial Sequence
  forward primer PPIP_34-57-KE
tcagttgacctatctccctcatgg

SEQ ID NO: 3644 - DNA, 19 bp, Artificial Sequence
  forward primer PPP1R26e3F1
cgtgtgggaacactggctg

SEQ ID NO: 3645 - DNA, 20 bp, Artificial Sequence
  forward primer RPRF_50-69-KE
gccaaccgtatgagcttcgg

SEQ ID NO: 3646 - DNA, 24 bp, Artificial Sequence
  forward primer RARS_30-53-KE
ttggacatttgcgttctaccatca

SEQ ID NO: 3647 - DNA, 24 bp, Artificial Sequence
  forward primer TNS3_6-29-KE
ccaggtgataaacttgtgatcgtg

SEQ ID NO: 3648 - DNA, 23 bp, Artificial Sequence
  forward primer Wnk1_45-67
gctggtgtttttaagatgggacg

SEQ ID NO: 3649 - DNA, 21 bp, Artificial Sequence
  forward primer SF3B_107-127-2a
ggcatcagctttgccattcat

SEQ ID NO: 3650 - DNA, 20 bp, Artificial Sequence
  forward primer SF3B_134-153-9a
ttggacagcctctctcccat

SEQ ID NO: 3651 - DNA, 20 bp, Artificial Sequence
  forward primer MEMO_37-56
tggagctctgagtgagtcaa

SEQ ID NO: 3652 - DNA, 20 bp, Artificial Sequence
  forward primer DHFR_5-24
ccatgaatcacccaggccat

SEQ ID NO: 3653 - DNA, 25 bp, Artificial Sequence
  forward primer GCFC2e2F1
ggagaaaaagaactttcatcaacag

SEQ ID NO: 3654 - DNA, 24 bp, Artificial Sequence
  forward primer FAM174Ae2F1
caggatgatgaggatgatgacaac

SEQ ID NO: 3655 - DNA, 29 bp, Artificial Sequence
  forward primer SOS2e19F1
ctgaaaaagagtttacagattatttgttc

SEQ ID NO: 3656 - DNA, 25 bp, Artificial Sequence
  forward primer COPS7Be2F1
cggagtgtatgtctttggagaactt

SEQ ID NO: 3657 - DNA, 27 bp, Artificial Sequence
  forward primer LMBRD2e16R1
ggaatcttctctattgtgtccataacg

SEQ ID NO: 3658 - DNA, 22 bp, Artificial Sequence
  forward primer ASAP1e11F1
taccccttcttttcactgccat

SEQ ID NO: 3659 - DNA, 19 bp, Artificial Sequence
  forward primer PPP1R26e3F1
cgtgtgggaacactggctg

SEQ ID NO: 3660 - DNA, 24 bp, Artificial Sequence
  forward primer NT5C2e12F1
aaaccactcttttttggagaaggc

SEQ ID NO: 3661 - DNA, 26 bp, Artificial Sequence
  forward primer ELMO2e2F1
aggtgtagaaagaggtacatggagaa

SEQ ID NO: 3662 - DNA, 20 bp, Artificial Sequence
  reverse primer ABCB_235-254
aggagctgcggtagccatca

SEQ ID NO: 3663 - DNA, 20 bp, Artificial Sequence
  reverse primer ANXA_302-321
gagccaccagtcactgttca

SEQ ID NO: 3664 - DNA, 20 bp, Artificial Sequence
  reverse primer ARL1_392-411-1a-KE
tgaggcctatgcaaaccagg

SEQ ID NO: 3665 - DNA, 23 bp, Artificial Sequence
  reverse primer DECA_168-190-KE
ccatgagacaaggtagcatctgt

SEQ ID NO: 3666 - DNA, 20 bp, Artificial Sequence
  reverse primer DHFR_209-228
tgcctttctcctcctggaca

SEQ ID NO: 3667 - DNA, 22 bp, Artificial Sequence
  reverse primer FAIM_367-388-KE
agcaacatcccaaacagctacg

SEQ ID NO: 3668 - DNA, 23 bp, Artificial Sequence
  reverse primer GXYL_246-268
aggaacggatgttgtcatcttca

SEQ ID NO: 3669 - DNA, 20 bp, Artificial Sequence
  reverse primer HTT_E51_Rev
gggtatttgtccttctttct

SEQ ID NO: 3670 - DNA, 22 bp, Artificial Sequence
  reverse primer MADD_288-309-KE
tctcctctgtctcaccaaggtc

SEQ ID NO: 3671 - DNA, 22 bp, Artificial Sequence
  reverse primer MEMO_218-239
tccccctgggattcatcatagt

SEQ ID NO: 3672 - DNA, 21 bp, Artificial Sequence
  reverse primer OXCT_236-256-KE
aatgaaaaacacgcagcctgg

SEQ ID NO: 3673 - DNA, 23 bp, Artificial Sequence
  reverse primer PAPD_183-205-KE
aaggtgagtatatgccgtgcttc

SEQ ID NO: 3674 - DNA, 21 bp, Artificial Sequence
  reverse primer PDXD_179-199
caagcaacaggggcagtcttc

SEQ ID NO: 3675 - DNA, 24 bp, Artificial Sequence
  reverse primer PMS1_285-308-KE
acatgagagccatcttgtgatctg

SEQ ID NO: 3676 - DNA, 24 bp, Artificial Sequence
  reverse primer PPIP_149-172-KE
ttcacctccccattttagaaccaa

SEQ ID NO: 3677 - DNA, 22 bp, Artificial Sequence
  reverse primer PPP1R26e4R1
gcgatgctttatttctctaccg

SEQ ID NO: 3678 - DNA, 20 bp, Artificial Sequence
  reverse primer RPRF_218-237-KE
tcgtttacctgtgtctgccg

SEQ ID NO: 3679 - DNA, 20 bp, Artificial Sequence
  reverse primer RARS_251-270-KE
atgccccaatcgccaaggta

SEQ ID NO: 3680 - DNA, 21 bp, Artificial Sequence
  reverse primer TNS3_96-116-KE
cggctccttgtccttcaacat

SEQ ID NO: 3681 - DNA, 21 bp, Artificial Sequence
  reverse primer Wnk1_187-207
ctgaggactctgaggtgctgg

SEQ ID NO: 3682 - DNA, 20 bp, Artificial Sequence
  reverse primer SF3B_256-275-2a
gtactttgccagtgttgggg

SEQ ID NO: 3683 - DNA, 21 bp, Artificial Sequence
  reverse primer SF3B_304-324-9a
actctcagagatgatcggggt

SEQ ID NO: 3684 - DNA, 22 bp, Artificial Sequence
  reverse primer MEMO_218-239
tccccctgggattcatcatagt

SEQ ID NO: 3685 - DNA, 20 bp, Artificial Sequence
  reverse primer DHFR_209-228
tgcctttctcctcctggaca

SEQ ID NO: 3686 - DNA, 23 bp, Artificial Sequence
  reverse primer GCFC2e3R1
gaataaaagctgcatctgggatc

SEQ ID NO: 3687 - DNA, 27 bp, Artificial Sequence
  reverse primer FAM174Ae3R1
caacattgatatagtggcttcttattc

SEQ ID NO: 3688 - DNA, 24 bp, Artificial Sequence
  reverse primer SOS2e20R1
ctgaagaagcagatactggtggag

SEQ ID NO: 3689 - DNA, 24 bp, Artificial Sequence
  reverse primer COPS7Be3R1
gtatgtcccataggcaaacaggtt

SEQ ID NO: 3690 - DNA, 24 bp, Artificial Sequence
  reverse primer LMBRD2e15F1
aaaggcaagaagaaggtgaaaatc

SEQ ID NO: 3691 - DNA, 24 bp, Artificial Sequence
  reverse primer ASAP1e12R1
gctaactgcactccgagacttaat

SEQ ID NO: 3692 - DNA, 22 bp, Artificial Sequence
  reverse primer PPP1R26e4R1
gcgatgctttatttctctaccg

SEQ ID NO: 3693 - DNA, 23 bp, Artificial Sequence
  reverse primer NT5C2e13R1
tagacgataccatgctgtagggg

SEQ ID NO: 3694 - DNA, 21 bp, Artificial Sequence
  reverse primer ELMO_232-252
ttgataatggatgccaggggc

SEQ ID NO: 3695 - DNA, 120 bp, Artificial Sequence
  iExon produced in gene ABCC3
ggcccataggaaggacgcaaaggcctgtgtgtgcaggccagaaaaaggctatccacacagggtggccaggacactttctcctgtaaggaagggatgcaccagccaggcctgaaagaatga

SEQ ID NO: 3696 - DNA, 66 bp, Artificial Sequence
  iExon produced in gene ADCY3
cggatcaaagattgaagaaagattgtactcctgtgtcgtggctccaacactgaggctgagatggga

SEQ ID NO: 3697 - DNA, 63 bp, Artificial Sequence
  iExon produced in gene AGPAT4
gatactgcagccatcagcagacaatcaatgcaatcatctcagactgtgtcctgcgtcccagga

SEQ ID NO: 3698 - DNA, 133 bp, Artificial Sequence
  iExon produced in gene ANKRA2
aagtactgtcagctttgaaggagaaggcttcatggaggagctgtgacttgactccagagtgaaaggataattaggattgatacaggacggaggaaggaaggcatccaggcaatctcaataaaagcatccatga

SEQ ID NO: 3699 - DNA, 121 bp, Artificial Sequence
  iExon produced in gene ANXA11
agtatctcctgcatgccagcaagctatggacatctggaagaagccacatgccttgccctcaagttgcttagggtggaaggaaatgattagaaatgagccaagccgagcctgcactcttaga

SEQ ID NO: 3700 - DNA, 141 bp, Artificial Sequence
  iExon produced in gene APIP
ctctgaaattaaatccctactgactggcccttgaactgattttttctaacatcagcaaaagtcaaggagtgtttccctaaaaaagaaagcatttactcagaaaccgtatattgaagtccaggctgaaaaatgcaaacatga

SEQ ID NO: 3701 - DNA, 276 bp, Artificial Sequence
  iExon produced in gene APPL2
tcagggctgtacgctgtggaccaaagatcatgctcgctgatgagagccaccctgctggtgacctcagtgctgccgacccatttacatcccagccctgccacattcctacagtgggaggttgaacacatttcttaaccttgatgagcctcagtttcatcatcagtaaaatgaagttaatggaaccatggaatctaccttggagagttgctagaagaattaaatgaagtcacatatgtttagtgcccagcacagcgtccagcacataggtggtacaga

SEQ ID NO: 3702 - DNA, 49 bp, Artificial Sequence
  iExon produced in gene ARHGAP1
ggccgtcaacctttccaccttgaaactggtgtcaggagcaccctgcaga

SEQ ID NO: 3703 - DNA, 82 bp, Artificial Sequence
  iExon produced in gene ASAP1
gttgttgcagctgcgcacctgctctgtgaagcacagattgtcatgggggcagttctctcaaaaacatggcatattgtgatga

SEQ ID NO: 3704 - DNA, 179 bp, Artificial Sequence
  iExon produced in gene ASAP1
agcaaaccccattgtcaggggaaagcagaacaaagaaaagtatttagaaatgtatttccgggatgcacagattcttttcaccctcaccttcccctaggttgttgcagctgcgcacctgctctgtgaagcacagattgtcatgggggcagttctctcaaaaacatggcatattgtgatga

SEQ ID NO: 3705 - DNA, 9 bp, Artificial Sequence
  iExon produced in gene ASAP1
tctaggaga

SEQ ID NO: 3706 - DNA, 16 bp, Artificial Sequence
  iExon produced in gene ASAP1
atcgaagtctaggaga

SEQ ID NO: 3707 - DNA, 58 bp, Artificial Sequence
  iExon produced in gene ASPH
tcattctgatctactgaaattccccagttcagactccattgaaagccctgggatggca

SEQ ID NO: 3708 - DNA, 174 bp, Artificial Sequence
  iExon produced in gene ATAD2B
gtcatctgagcaaatgtaatcactcatctacccacaaaatggctaaatgacttaattcaactccctttgttgatttgcctgttagtttgtttatctggtggtctatctattaaatgtttattgagtacctgcagtgccagatgctgtgctgggtgtttggaatgcaaaaaatga

SEQ ID NO: 3709 - DNA, 99 bp, Artificial Sequence
  iExon produced in gene ATXN1
tttcataaagaggacagacgctaaggcaattgtgtggaacagagcagcttctcggggtaaccatctcctgctgatgtataaatatcggggcaaaactga

SEQ ID NO: 3710 - DNA, 39 bp, Artificial Sequence
  iExon produced in gene BECN1
gatcccattgatggatggaaactctagtttttacttaga

SEQ ID NO: 3711 - DNA, 88 bp, Artificial Sequence
  iExon produced in gene BHMT2
gatgttttcatctggcccaagaagaacttgttcttaatgttaaaagacctttttgctaaactgggaagaaagtgctggaataacaaga

SEQ ID NO: 3712 - DNA, 92 bp, Artificial Sequence
  iExon produced in gene BICD1
gtcaatttctgccttgtggataattttctgaatctgtaatatttctgaagattcctccaagtatttacagaacatacagaagtattttatga

SEQ ID NO: 3713 - DNA, 93 bp, Artificial Sequence
  iExon produced in gene BTN3A1
atcttgttctcagaggccattcccagacccacagcaagagggattatggctgcaggcctcatgctcctttgttttggaagaaactgttgagga

SEQ ID NO: 3714 - DNA, 90 bp, Artificial Sequence
  iExon produced in gene C11orf30
gccttgttcaaagctctgggcatctagcaatgagtaagatagtcaagatctgtgctctgtccacgttctcttggagcttacattttaaga

SEQ ID NO: 3715 - DNA, 164 bp, Artificial Sequence
  iExon produced in gene C11orf73
gtaattattgaacatctacttgctgcctactttcaacatctgcatgtgtgtgtgaatattaaatatcacaccaagacattgttcagaggagacagaatagtgagctgagataaatgagaatctctctatggaagattagactggagcatgaacttgaaatatga

SEQ ID NO: 3716 - DNA, 93 bp, Artificial Sequence
  iExon produced in gene C14orf132
aacaaagacaaatcccggatttctccatcagtctgtgaccctagagaagacccagagctggctccagggaagggctgcgtttggcctgggaga

SEQ ID NO: 3717 - DNA, 68 bp, Artificial Sequence
  iExon produced in gene C8orf88
tgttccctttcaactttcaaaacgaatatccatgcaacactcagtgcatacaaagtggagttagcaga

SEQ ID NO: 3718 - DNA, 47 bp, Artificial Sequence
  iExon produced in gene CASC3
gagaaagtttcctgtcttttggataaactactagagatgccatcaga

SEQ ID NO: 3719 - DNA, 131 bp, Artificial Sequence
  iExon produced in gene CASP7
ggttgcagagagcactggttgaagcctatcctgaagctaccttggtagaggagttaattgcaccaggagacctaatttcagaaaggtcacagattatattccaccctccacaaaagtaacctggaagatga

SEQ ID NO: 3720 - DNA, 34 bp, Artificial Sequence
  iExon produced in gene CCDC122
taacatattttattgaggtataattgtcataaga

SEQ ID NO: 3721 - DNA, 34 bp, Artificial Sequence
  iExon produced in gene CDH13
gttttttgggaacaggtggtgtttggttacatga

SEQ ID NO: 3722 - DNA, 82 bp, Artificial Sequence
  iExon produced in gene CECR7
cgagaggaagaggagaagcatgcaggagtgtacatgaaacaagattggccacgagatgacaaatatctgaatccgctgatga

SEQ ID NO: 3723 - DNA, 97 bp, Artificial Sequence
  iExon produced in gene CEP112
aaccaacttcaagatggctgcagcagtgccaggcattctgcccagatctgcactattcggaggcagaaaagggctgccagtttctagggcctaatga

SEQ ID NO: 3724 - DNA, 83 bp, Artificial Sequence
  iExon produced in gene CMAHP
aatgaacactccatgagagcagggacctgctttgccttgttcaccactttattcccagtggctagaaccacgtctgacacaga

SEQ ID NO: 3725 - DNA, 154 bp, Artificial Sequence
  iExon produced in gene CNRIP1
gtcttactcttgtcaccgaggctggagtgcagtggtgtgatcatagctcactgcagcctcaacctcctggatccaagtgatcctcctgcctcagcctcccaagttgctggcactacaggtgtggtatcaccacacccggttaactaaaaaaaat

SEQ ID NO: 3726 - DNA, 136 bp, Artificial Sequence
  iExon produced in gene CNRIP1
ttaaccgggtgtggtgataccacacctgtagtgccagcaacttgggaggctgaggcaggaggatcacttggatccaggaggttgaggctgcagtgagctatgatcacaccactgcactccagcctcggtgacaaga

SEQ ID NO: 3727 - DNA, 141 bp, Artificial Sequence
  iExon produced in gene CPSF4
aagagacaggatttcaccgtgacagccaggatggtctccgtgccagccaggatggtctcgatctcctgaccttgtgatccgcccacctcggccttccaaagtgctgggattaccagcgtgatccactgcgcccggccatga

SEQ ID NO: 3728 - DNA, 259 bp, Artificial Sequence
  iExon produced in gene CRISPLD2
attgggtcttatccccaagatatctcattatgtacatgcaaatcagcggagcatcgtcatgacaccaggaggacaccccgtgacgccgattaccgcactctcaacctcaacccagcgtcagagttttctggcatctcttctttgagcctggccgcctgcagctggaaatgctcatatatggtggtgtgactaacctgagagagagagatcagggatcctgagaagttctgcattcttggtctgcttcccagtgggacga

SEQ ID NO: 3729 - DNA, 61 bp, Artificial Sequence
  iExon produced in gene CRYBG3
ggcctttctgtctggtgtgtgcagaatgatctgggtcacctctgaggcccatatttataga

SEQ ID NO: 3730 - DNA, 34 bp, Artificial Sequence
  iExon produced in gene CSNK1G1
gttattggggtacagatggtgtttggttacatga

SEQ ID NO: 3731 - DNA, 227 bp, Artificial Sequence
  iExon produced in gene DAGLB
ttggatcatcatcgctgccacagtggtttccattatcattgtctttgaccctcttggggggaaaatggctccatattcctctgccggccccagccacctggatagtcatgattcaagccagttacttaatggcctcaagacagcagctacaagcgtgtgggaaaccagaatcaagctcttgtgctgttgcattgggaaagacgaccatactcgggttgctttttcga

SEQ ID NO: 3732 - DNA, 178 bp, Artificial Sequence
  iExon produced in gene DCAF17
ttttgccaaggagtttgtccacagagctcttcatgccctcatgctggaagtggaaatctggacatgttatcttatcatgtcattatcacacctaggaaaatgagcaacaattcttcaggatcatttaatgtcaagtttataacttcctgctttaacttaaaaaaaaaattaaattaga

SEQ ID NO: 3733 - DNA, 56 bp, Artificial Sequence
  iExon produced in gene DCUN1D4
gccgaagatggtgttagtgattgcgagctgctggctggcacccttgcagagcagga

SEQ ID NO: 3734 - DNA, 158 bp, Artificial Sequence
  iExon produced in gene DDX42
gtgcagtttgaacagggcttgacagtggctggaccatcactaagtgagactttaattcatcaagcataactgaaaatggaggcagtagattatatcttggtagccagcatgtgtagacttgtcttatttggagcccacttggaattttcatttcaaga

SEQ ID NO: 3735 - DNA, 59 bp, Artificial Sequence
  iExon produced in gene DENND1A
ctgtggcataagaatgaaaagaaaagaaacaaaagcagatggcagagaaaacgaaagga

SEQ ID NO: 3736 - DNA, 131 bp, Artificial Sequence
  iExon produced in gene DENND5A
gccaaaatcatattatatgatcaacctcaagtgcatgggaagctgtgaaagtgaacattgaactgggtataatgttaccctgaacagtatgaaggtctatgagcaagaaagaaggggtgaatgaattatga

SEQ ID NO: 3737 - DNA, 46 bp, Artificial Sequence
  iExon produced in gene DENND5A
ataggacagcatttaaaaatctcatgtggaagaatataccactaga

SEQ ID NO: 3738 - DNA, 97 bp, Artificial Sequence
  iExon produced in gene DGKA
acctgggcctcccaagcattatccagctcagttcctgcctggcacatggatggtgtggggcaggcatgcagtagcagctgatcttttaggaggaaga

SEQ ID NO: 3739 - DNA, 122 bp, Artificial Sequence
  iExon produced in gene DIAPH3
gtaaattagacccaaaataactcccagggagcaatacacagcctggaaaacatgaaacaaggagcggctgtttggtgtaataaaggaggagcaccaggctgaattttcagaggcctaataga

SEQ ID NO: 3740 - DNA, 48 bp, Artificial Sequence
  iExon produced in gene DIAPH3
ggttttgttcctaatgtcacatgtttcctaagtaattcagcataaaga

SEQ ID NO: 3741 - DNA, 80 bp, Artificial Sequence
  iExon produced in gene DLGAP4
gagaggactagaaggaacggttcccacctctcggaggacaacggacccaaagcgatcgatgtgatggcaccctcctcaga

SEQ ID NO: 3742 - DNA, 164 bp, Artificial Sequence
  iExon produced in gene DNAJC13
cccactgtggagacctactgctcaggaaaaaaagagctttcaaaatactactgctcgttggcaatgcacctggtcacccaagagctccgatggagatgtacaaggagattaatgttttcatgcctgctaatacagcatccattttgcagcccatggatcaagga

SEQ ID NO: 3743 - DNA, 82 bp, Artificial Sequence
  iExon produced in gene DNMBP
tttgaaaatcaaatattgaatgcaaaagctaggaagctgtaaacaggaaacgtaaacgagaaagaacaagcagtgaatacga

SEQ ID NO: 3744 - DNA, 82 bp, Artificial Sequence
  iExon produced in gene DNMBP
cattggccaggactactagaactgtgtcaaaacagctgctacactaacgggcatctttgtcttgttctcagtcttaaaaaga

SEQ ID NO: 3745 - DNA, 55 bp, Artificial Sequence
  iExon produced in gene DOCK1
gaacgttggggatgcagatgaccagtatctagtgctgcgtgactttggattacga

SEQ ID NO: 3746 - DNA, 71 bp, Artificial Sequence
  iExon produced in gene DYRK1A
gttcagggatgctggaaaggacactgaagtaggccttggctgatgggcctttcagaagtgaacacttaaga

SEQ ID NO: 3747 - DNA, 85 bp, Artificial Sequence
  iExon produced in gene EIF2B3
ggaactgacttgttttccaatggaggaggaacatttgctgcctacactggtttgaagcattaaaaggggagaaaaagagctaaga

SEQ ID NO: 3748 - DNA, 92 bp, Artificial Sequence
  iExon produced in gene ENOX1
ttactctagaagtcgtactacattttctgagagaagtaggaggtgagacgagagtaagtaacttctgctctctgaatatttcaattaggcag

SEQ ID NO: 3749 - DNA, 63 bp, Artificial Sequence
  iExon produced in gene ERC1
acagacccttccagaaccagatgaccatcaagacaaaagcatactcaagcagacaagaaagga

SEQ ID NO: 3750 - DNA, 72 bp, Artificial Sequence
  iExon produced in gene ERCC1
gtgactgaatgtctgaccaccgtgaagtcagtcaacaaaacggacagtcagaccctcctgaccacatttgga

SEQ ID NO: 3751 - DNA, 15 bp, Artificial Sequence
  iExon produced in gene ERGIC3
tacatgctgtggaga

SEQ ID NO: 3752 - DNA, 98 bp, Artificial Sequence
  iExon produced in gene ERLIN2
ggccaaaggaataactgggaaggtggatgcgaggccaacgaatcctaccttgaaactctgctcgcctgctggctctgccactccagcatctgaaagga

SEQ ID NO: 3753 - DNA, 108 bp, Artificial Sequence
  iExon produced in gene EVC
ttccatacaactatcccgctgattctttcttcaaagaagcaaaccctcctttgctttttatattttcttcacacatggaaatgggggatgtggagggccttgcacaga

SEQ ID NO: 3754 - DNA, 69 bp, Artificial Sequence
  iExon produced in gene FAF1
taatttttaacagtgtaaaggggtcctgagaccaaaaagtttgagaactgctgcaatcaactataaaga

SEQ ID NO: 3755 - DNA, 95 bp, Artificial Sequence
  iExon produced in gene FAIM
gctggtctcgagttcctggcttcaaatgattctcctgtctcagcctctcaaagtgcggggattacagggatgagccaccatgcacactccaagga

SEQ ID NO: 3756 - DNA, 62 bp, Artificial Sequence
  iExon produced in gene FAM126A
gtcaatttttctgaccacctgaacagattgttttctgtcaattaagggcagctttgttacga

SEQ ID NO: 3757 - DNA, 34 bp, Artificial Sequence
  iExon produced in gene FAM13A
gttttggggaaacagatggtgtttgcttacatga

SEQ ID NO: 3758 - DNA, 58 bp, Artificial Sequence
  iExon produced in gene FAM174A
actgctgtggaattcctgagaaagagcaactgagggatagcaacatggatttcactga

SEQ ID NO: 3759 - DNA, 101 bp, Artificial Sequence
  iExon produced in gene FAM198B
cagcagcagcagcgtgtctttccatgcgcttggcattctttattttcccagcctgggaggatatgagagttccagggaaatgctgtattggacatgcaaga

SEQ ID NO: 3760 - DNA, 81 bp, Artificial Sequence
  iExon produced in gene FBN2
gattaattaccgttaatgtcttggagactataacgtacactgcacgttgtaataacacaaaaggacaagcaagatgtaaga

SEQ ID NO: 3761 - DNA, 34 bp, Artificial Sequence
  iExon produced in gene FER
gtttctggggagcaggtggtgtttgcttacatga

SEQ ID NO: 3762 - DNA, 92 bp, Artificial Sequence
  iExon produced in gene FHOD3
gacaaaaagcaaagaagaagactgtggtctagaagccgaaggaagatgagaaggaagagtgtccgaggagtcagccacagccagaaaggaga

SEQ ID NO: 3763 - DNA, 47 bp, Artificial Sequence
  iExon produced in gene FOCAD
cattgactccgttatctacacaataaaatctggatccacagataaga

SEQ ID NO: 3764 - DNA, 34 bp, Artificial Sequence
  iExon produced in gene GALC
gtttttggagaataggtggtatttggttacatga

SEQ ID NO: 3765 - DNA, 103 bp, Artificial Sequence
  iExon produced in gene GCFC2
caagagagaaagagaggaatcaagaatgggtccattgaggaattggcctgagcaactggaaggacagaggtgccatttcctgaaatgaaaaagtctgacagga

SEQ ID NO: 3766 - DNA, 96 bp, Artificial Sequence
  iExon produced in gene GGACT
taagatgctatgaggaaatccgtgcacgagggatgacagcgtggcaggctggaacacgctttttagatttactttcgtggactggatctgttaaga

SEQ ID NO: 3767 - DNA, 58 bp, Artificial Sequence
  iExon produced in gene GLCE
ggcagaggtggagaggggttagattatttcatctgccctacagttggcataataaaga

SEQ ID NO: 3768 - DNA, 116 bp, Artificial Sequence
  iExon produced in gene GOLGA4
gtccagggattgaaggctggggagtagagccatcctgggtcaggctgctggtaggagcggtgggacctgaaagacgtggcggcgtggccggcgtccagcgcccgaggctgtcacga

SEQ ID NO: 3769 - DNA, 47 bp, Artificial Sequence
  iExon produced in gene GOLGB1
aggtgcctgatgctgttaattcctgagccttttgaagattctgcaga

SEQ ID NO: 3770 - DNA, 64 bp, Artificial Sequence
  iExon produced in gene GXYLT1
ggattgtttgtattcctgccaatgatttgtgagacagtctgttccccacatcctcgtcaacaga

SEQ ID NO: 3771 - DNA, 76 bp, Artificial Sequence
  iExon produced in gene HAT1
ttcgttttcctgaagatcttgaaaatgacattagaactttctttcctgagtatacccatcaactctttggggatga

SEQ ID NO: 3772 - DNA, 100 bp, Artificial Sequence
  iExon produced in gene HLTF
tcttgctctgtcgcccaggctggagtgcaatggcgcgatctcagctcactgcaacctccacctcccaggttcaagtgatcctgctgcctcagcctcttga

SEQ ID NO: 3773 - DNA, 16 bp, Artificial Sequence
  iExon produced in gene HMGA2
cttgttgggaataaga

SEQ ID NO: 3774 - DNA, 290 bp, Artificial Sequence
  iExon produced in gene HNMT
ataccagaattgctgttaacaaataaaatactggccagatgtgttggttcacgcctgtaatcctagcacttcgggaggctgaggcgggaggattacttgagcctaggagtttgagaccagcctgggcaacatagcaagatcccatctctacaaaaaagtgaaaaagttagctgaacaaggcggcatgcacatgctactccagacgctgaagtgggaagatcacttaagtccgagagatcgaggcttcagtgagatatggctgagacactgctctcagcctggatgacaga

SEQ ID NO: 3775 - DNA, 143 bp, Artificial Sequence
  iExon produced in gene HPS1
tttggagaatgcctgttcattgccatcaatggtgaccacaccgagagcgagggggacctgcggcggaagctgtatgtgctcaagtacctgtttgaagtgcactttgggctggtgactgtggacggtcatcttatccgaaagga

SEQ ID NO: 3776 - DNA, 34 bp, Artificial Sequence
  iExon produced in gene HSD17B12
gttattggggaacaggtggtgtttggttacatga

SEQ ID NO: 3777 - DNA, 78 bp, Artificial Sequence
  iExon produced in gene HSD17B4
ctttctgacatcttaacgaggcaatacagagagacgaattttcatcagtttgttcagggagacacatataacaaaaga

SEQ ID NO: 3778 - DNA, 115 bp, Artificial Sequence
  iExon produced in gene HTT
aggcaagccctggtgctgtgggagccccaaggaagagcctctggcctggtggccacgtagcccaggagagatttctacaggagcccacagcgctgaaggagagagaggcagcaga

SEQ ID NO: 3779 - DNA, 51 bp, Artificial Sequence
  iExon produced in gene IFT57
atccatacatacttaatgctgaaatgtgaagggctgagaaaaaagaaaaga

SEQ ID NO: 3780 - DNA, 231 bp, Artificial Sequence
  iExon produced in gene INPP5K
cacatacatcaggaggtctgcctgatcccatggtgaaccccgggaatccgaaatcagattgagataagatcctttagggaagtgacttagcctggtctcttgcctgctctttcacggggaacaacgctaatcgcccacttagtctaagtcacgatgcttggatttgctgctaatcgtcggatttgagagtgggaacaagaaatccggacttttgctctccatcctcttaga

SEQ ID NO: 3781 - DNA, 95 bp, Artificial Sequence
  iExon produced in gene IVD
ctctgaatggcctgtctcctggacaaagaagctttcacggactactctgcagggaggtgacattggaccagagctgactccacctgggggaaaga

SEQ ID NO: 3782 - DNA, 181 bp, Artificial Sequence
  iExon produced in gene KIAA1524
gtcaggaattatggttaaaggtggattttcactgatggtaataagatattactttataccccttccctcctcatgaattaagtccatctaatctttactgaggacctgctgagtggtagacactatgatttgtttctgtttccacagatgtcacaattgtcagtaattgtggacctttaga

SEQ ID NO: 3783 - DNA, 219 bp, Artificial Sequence
  iExon produced in gene KIAA1715
ttctcaggttttcttgacaccaagaaagagagggaatcaagaagatcggttgtaagagagcaattcaacatgaaaatactgaagaagagatgggagagagagagagataattgttttcttcagagttttccactttctatcagtaactctgatcacatggatatctattgtggggctagttgatgcatcccttcagatgtgttggaaagaggaccaaga

SEQ ID NO: 3784 - DNA, 52 bp, Artificial Sequence
  iExon produced in gene LUC7L3
tgtaggaaagcaagttggtgctagatgactccttttaggactttaagaaaga

SEQ ID NO: 3785 - DNA, 82 bp, Artificial Sequence
  iExon produced in gene LYRM1
gtgaagtagtatttgaagcttttcatcagttggctcattctttactcaagaataaacctcaagaaacgtcatcagggtcaga

SEQ ID NO: 3786 - DNA, 54 bp, Artificial Sequence
  iExon produced in gene MADD
aattgtggaacaagcaccaggaagtgaaaaagcaaaaagctttggaaaaacaga

SEQ ID NO: 3787 - DNA, 79 bp, Artificial Sequence
  iExon produced in gene MB21D2
gcatgtttatgtgggaatgtctctccatgtttacaaacttcagaaggcccctttgggaaagaaaacctctcagagaaga

SEQ ID NO: 3788 - DNA, 99 bp, Artificial Sequence
  iExon produced in gene MCM10
tcttgctctgttgccaggctagagtgcagtggcgcagtcttggctcgctacagcctctgcctcctgggttcaagcgatcctcctgcctcagcctcacga

SEQ ID NO: 3789 - DNA, 92 bp, Artificial Sequence
  iExon produced in gene MED13L
gtcatttttaacatggattcttagatgctgacaaatattgccaaattccattccaaaagaggttacacttatttcctttcatcagtgaatga

SEQ ID NO: 3790 - DNA, 96 bp, Artificial Sequence
  iExon produced in gene MED13L
ctcctctgagtgttcctccaaatctgtcttttggagtagacctagaaatcatctgttactaaggtgtactatgcatgtggaaccattgatttaaga

SEQ ID NO: 3791 - DNA, 175 bp, Artificial Sequence
  iExon produced in gene MEDAG
gagaggccaggaacagaatgcccagtaacaagaagtgctcattagaacatctgaagcccacgtgttctttggcttgattataaccagaaagccagatagttctttaggaatgtaattcacagctgtatcaagtacacctcctgcaccgatcactcaggaggaatctaaaaaaaga

SEQ ID NO: 3792 - DNA, 53 bp, Artificial Sequence
  iExon produced in gene MEMO1
aaagcgtgctctggaatggattcacaaatgagctaccctccttccctcaaaga

SEQ ID NO: 3793 - DNA, 135 bp, Artificial Sequence
  iExon produced in gene MMS19
cattaatttacagaaatacacgtattctccttgttttggtggaagctgcagctgccaatcatctctcaaaccctgtgggtagctgctaagctgtatttcagaggaatgtcacaatcataccactggggagaaaga

SEQ ID NO: 3794 - DNA, 75 bp, Artificial Sequence
  iExon produced in gene MRPL45
gtctgggtggtggctcatacccgtaatccagcacttttggaggccgaagtgggaggattgtttctgggcagcaga

SEQ ID NO: 3795 - DNA, 122 bp, Artificial Sequence
  iExon produced in gene MRPS28
atgggacctgcaaaggataaactggtcattggacggatctttcatattgtggagaatgatctgtacatagattttggtggaaagtttcattgtgtatgtagaagaccagaagtggatggaga

SEQ ID NO: 3796 - DNA, 42 bp, Artificial Sequence
  iExon produced in gene MTERF3
ggacgtgtctccgtgctaaagacctagagattacaacgatga

SEQ ID NO: 3797 - DNA, 89 bp, Artificial Sequence
  iExon produced in gene MYCBP2
gcatctagcatagaactccctattctgcattatgactactggaccacttatctctctgccctacttgataagttccatgaggacaaaga

SEQ ID NO: 3798 - DNA, 156 bp, Artificial Sequence
  iExon produced in gene MYCBP2
gtgaccaactgagtgccatattgaattccattcagtcacgacccaatctcccagctccttccatctttgatcaagctgcaaaacctccctcttccctagtacacagcccatttgtgttcggacagcccctttccttccagcagcctcagcttcaga

SEQ ID NO: 3799 - DNA, 118 bp, Artificial Sequence
  iExon produced in gene MYOF
ggtgagaagtttctgaaggtgcttgaacgctcttcttccacacgagggcaccaagttgaagcgggaagaacactgagccatcagttagaaggctcaggatatggtccagttctaacga

SEQ ID NO: 3800 - DNA, 74 bp, Artificial Sequence
  iExon produced in gene NREP
tgttccagggcgccattaacgattggagttggcacaaaatttgaaactagaagtggactatttgctccttgaga

SEQ ID NO: 3801 - DNA, 84 bp, Artificial Sequence
  iExon produced in gene NSUN4
gggctcaggagtccagcggtcctaagtataccttgcagccatcttcctaaaagttctgaccatgactgaggacactgagaagga

SEQ ID NO: 3802 - DNA, 49 bp, Artificial Sequence
  iExon produced in gene NT5C2
agttttggtcttaactgaaacagtcaaacaaacccactaattgaaaaga

SEQ ID NO: 3803 - DNA, 47 bp, Artificial Sequence
  iExon produced in gene OSMR
cttcctgagagtttcttggcctatacccagctgaagtgcagggaaga

SEQ ID NO: 3804 - DNA, 75 bp, Artificial Sequence
  iExon produced in gene OXCT1
attttgaaagaagtctgtctctcaaatatttaaagaatcaaaatgatgtcgtattaaagcttgacaagctaatga

SEQ ID NO: 3805 - DNA, 63 bp, Artificial Sequence
  iExon produced in gene PAPD4
agctctacctctgttttgaaatgtcattagtttggatatgttaccaggatgcagcaaagaaga

SEQ ID NO: 3806 - DNA, 103 bp, Artificial Sequence
  iExon produced in gene PCM1
ttatggaccagcatttccatcttttactggcctgaaataatataataaaatctttaagccaccataagatatctaaggaaaataactgtatgtggtttaaaga

SEQ ID NO: 3807 - DNA, 141 bp, Artificial Sequence
  iExon produced in gene PDS5B
gcattagaaacattcatattatgaaaatactacctttttattctcacttggtgtactgatgtgcattacggtggagagcagtaggctgcagattttgtgctgcatagcctgagcagcaccgtgttatagtttgacataaga

SEQ ID NO: 3808 - DNA, 190 bp, Artificial Sequence
  iExon produced in gene PIK3R1
tgctctacaagtatagaaagaagccttcctcttcccaccgtccccagacaccacataatggaaaaagcaagaattttctgcataagcaaggccttaaaaaaaaaaaagccagcctctgatgggacttctttcctgccagaaatcccactggtccactgtcgcaatttttacaaaaggccacgatgaaaga

SEQ ID NO: 3809 - DNA, 66 bp, Artificial Sequence
  iExon produced in gene PIKFYVE
tggaaagaacctcatttgagctatgcttggtcacagacctagagaaagttcacggggaagtaaaga

SEQ ID NO: 3810 - DNA, 202 bp, Artificial Sequence
  iExon produced in gene PITPNB
gcgaaaatgggcagtgtttacaggcatgaatgctggtggaaagagcagagtaagggcagattgcacaagaaccgtggaggccctggttcccatcacctccacctcagcacagacttcagagaggagaggaggcactggatgcatgacagcagcacttgagataggtgctccaggtggaaggcactgcacatgcaaaggctga

SEQ ID NO: 3811 - DNA, 47 bp, Artificial Sequence
  iExon produced in gene PITPNB
tgagcttggagtgaagtctagtacgtctgtgcagcaaagagaccaga

SEQ ID NO: 3812 - DNA, 49 bp, Artificial Sequence
  iExon produced in gene PLSCR1
gaccacataaacccattttgaattattcaaccattgctgaacttcttga

SEQ ID NO: 3813 - DNA, 92 bp, Artificial Sequence
  iExon produced in gene PMS1
ggattcccccagcagacgtttttcatctaagaaatggcttgagtgcttccttttatcgggtgctgtgatagattctcaaaatatgaaaatga

SEQ ID NO: 3814 - DNA, 33 bp, Artificial Sequence
  iExon produced in gene PPIP5K2
aacccaacacagatcttaataccatgaaaagga

SEQ ID NO: 3815 - DNA, 181 bp, Artificial Sequence
  iExon produced in gene PRSS23
agcaatctctttgtatttatacaattatgacaacagtagtaagagaagaaggttcagaggatacaaggtaacacacctacataaacgacctactgggtacaaatattgtaaatcaacataggcctagaaaaggtggtcagatgctgaattttgactaaatacctccgatggcacataatga

SEQ ID NO: 3816 - DNA, 48 bp, Artificial Sequence
  iExon produced in gene PRUNE2
aactagctgcctttacaatgatccagaaatgtcttctatggagaagga

SEQ ID NO: 3817 - DNA, 67 bp, Artificial Sequence
  iExon produced in gene PSMA4
agagacgcaacatccacaagcttcttgatgaagtctttttttctgaaaaaatttataaactcaatga

SEQ ID NO: 3818 - DNA, 96 bp, Artificial Sequence
  iExon produced in gene PXK
ctgtaaagtttgactgagaaatgttgcatcagccctgaagtttattgagaaaatcttacgctgatgcaaactttttggactgttagtgtcttatga

SEQ ID NO: 3819 - DNA, 60 bp, Artificial Sequence
  iExon produced in gene RAF1
aataacaacctgagtgcttctcccagggcgtggtccagacgattttgtttgaggggaaga

SEQ ID NO: 3820 - DNA, 138 bp, Artificial Sequence
  iExon produced in gene RARS2
aattggagaaattagtacttgtggcatagattgttgtgcggtcagctcttactgttcttgagcagcattttaagagaagaaatgacaggacttgatgaaaaagtataagaaatatacagtataaaaaaagctatatga

SEQ ID NO: 3821 - DNA, 116 bp, Artificial Sequence
  iExon produced in gene RFWD2
gactaagatttgaatttattatgtatatgaagatcttaaaatttaagccattagctaaagaaactattggaggagatcttttattgtattctgtcagctgtttaactcagtaatga

SEQ ID NO: 3822 - DNA, 77 bp, Artificial Sequence
  iExon produced in gene RNFT1
gaatttctcttggaattgggctgctaacaacttttatgtatgcaaacaaaagcattgtaaatcaggtttttctaaga

SEQ ID NO: 3823 - DNA, 59 bp, Artificial Sequence
  iExon produced in gene RPA1
acgtcagctatcagtttaagcattacttctatgcctagtttgctgagactttataatga

SEQ ID NO: 3824 - DNA, 41 bp, Artificial Sequence
  iExon produced in gene RPS6KB2
gacgcatgtccccttgccgagttgagggcagctggcctaga

SEQ ID NO: 3825 - DNA, 102 bp, Artificial Sequence
  iExon produced in gene SAMD4A
atgtgatgggaagtctctggaagagttgagaaggagaatgaaggcgcttcattgacccttgaaaatgaccactctgaatgcggcacagagagtaatgaaaga

SEQ ID NO: 3826 - DNA, 118 bp, Artificial Sequence
  iExon produced in gene SAR1A
tgcatctaagtggcattctgattcacattattgataagactgatttcctagagttgttcttcactggatgacagcagtcgtatgtctagggaatgtgaatgaaccgctgcctggagga

SEQ ID NO: 3827 - DNA, 60 bp, Artificial Sequence
  iExon produced in gene SCO1
agaaaggatttgaacttggccttcatgtatcaactaagttaatcgagccttgaattgaga

SEQ ID NO: 3828 - DNA, 112 bp, Artificial Sequence
  iExon produced in gene SEC24A
agaccgggtctctcgttgtcacccaggttagagtgcagttccatgatcatagctcactgcagccttgaactcttgggctcaagcagtcctcctgcctcagcctccagacaga

SEQ ID NO: 3829 - DNA, 65 bp, Artificial Sequence
  iExon produced in gene SERGEF
gtgtcttcaaaaacaaacatatttaaaagattttacttctcatctccaggaagaaccagctagga

SEQ ID NO: 3830 - DNA, 53 bp, Artificial Sequence
  iExon produced in gene SH3YL1
gtaacagaaatgaatataagctctatcctggactttccagctatcatgagaga

SEQ ID NO: 3831 - DNA, 100 bp, Artificial Sequence
  iExon produced in gene SKA2
aaaaatccagttacactcttaaaggaattgtcagtgataaagtctcgatatcaaactttgtatgcccgctttaaaccagttgctgttgagcagaaagaga

SEQ ID NO: 3832 - DNA, 76 bp, Artificial Sequence
  iExon produced in gene SMYD3
ctatatcagaaaagcaggaaaccagagaaaatatacctatttgaaagtggcatgtcagctgggatgagagagaaga

SEQ ID NO: 3833 - DNA, 36 bp, Artificial Sequence
  iExon produced in gene SNAP23
tattggaatatgacagggaagatgaattcactatga

SEQ ID NO: 3834 - DNA, 90 bp, Artificial Sequence
  iExon produced in gene SNHG16
aggcctttctttgtttggcatctgcagagacggtgaaaagcagagctccaggttgaaggatcagagtaatagatggagcccttaacatga

SEQ ID NO: 3835 - DNA, 144 bp, Artificial Sequence
  iExon produced in gene SNX7
agtttgcaaaggaaggaaaggagcagagacttgaatgagcagaaaatcatttcagggcctgttctctatgtccttgctatccctgtcttctgtagctattctgaaaccatcaacaaaggagcacaccattccatcagcaaaaga

SEQ ID NO: 3836 - DNA, 64 bp, Artificial Sequence
  iExon produced in gene SPATA5
aacctttatataaatggaatcatactgtatacaaccttttggaattagcttttttcacatatga

SEQ ID NO: 3837 - DNA, 114 bp, Artificial Sequence
  iExon produced in gene SPIDR
gtattcagtagaagcagatgaacagccagatgaagagatggatagagcaagacatggacattataaaggaattcaatagaagcacatgaacggccagatgaagagatggataga

SEQ ID NO: 3838 - DNA, 129 bp, Artificial Sequence
  iExon produced in gene SPRYD7
gtgtggttgtacgtgcctgtagtcccagctacttgagaggctgagctgagaggatctcttgagccggggaggtcaagtctcctgtgagcagtgatcatcgtgccgctgcactccagccttggcaccaga

SEQ ID NO: 3839 - DNA, 70 bp, Artificial Sequence
  iExon produced in gene SRGAP1
tcacagataccacgtgttaatatctaaagtagaaaaaggaataaagcaaaggaggacaaaaagaaaagga

SEQ ID NO: 3840 - DNA, 79 bp, Artificial Sequence
  iExon produced in gene STAT1
gtttgttatctgcagatcaaggatgtgagtcaatgtaatctgcaacccgttcttggaaggaatcacatttcccacagga

SEQ ID NO: 3841 - DNA, 99 bp, Artificial Sequence
  iExon produced in gene STXBP6
gtggtccctgagttaagaacatgcaatggcactctctcaaggagaggaaggagccaaagaagaaagaggtccaaagcagaaaagagcagacagctaaga

SEQ ID NO: 3842 - DNA, 99 bp, Artificial Sequence
  iExon produced in gene SUPT20H
ttgaagacgataattctaacttcctgtcagttgaagacgataattctaacttcctgtcagttgaagacgataattctaacttcacacttaattaaaaga

SEQ ID NO: 3843 - DNA, 156 bp, Artificial Sequence
  iExon produced in gene TAF2
gaagatgatcaccttgccaaggaagcatcatgtaatatatcagctcatcagcagggagtgaagaggaagtctgatacaccactggggtccccactagaacctggtcaaatactggagaagaatgaggatagcagtaaagtcaaactcaaaatcaga

SEQ ID NO: 3844 - DNA, 83 bp, Artificial Sequence
  iExon produced in gene TAF2
ttttgagatccaccaaatatgtcattgttgccagtcttctttcccaagatgtatggatagtttttaatgtctcataaatatga

SEQ ID NO: 3845 - DNA, 162 bp, Artificial Sequence
  iExon produced in gene TBC1D15
tttgacagacctgaaatcaatcaagcaaaacaaagagggtatgggctggtcctatttggtattctgtctaaaggatgacgtcgttctccctgctctacactttcatcaaggagatagcaaactactgattgaatctcttgaaaaatatgtggtattgtgtga

SEQ ID NO: 3846 - DNA, 34 bp, Artificial Sequence
  iExon produced in gene TCF12
gtttttggggaacaggtggtatttggtgacatga

SEQ ID NO: 3847 - DNA, 87 bp, Artificial Sequence
  iExon produced in gene TJP2
ggattggtgtctctatcatccagctggccattaaacaaccaaagcttcatcatcctagataacctgtgagctctcagaggagacaga

SEQ ID NO: 3848 - DNA, 149 bp, Artificial Sequence
  iExon produced in gene TMEM189-UBE2V1
gagtaaaagtccctcgcaatttccgactgttggaagaactcgaagaaggccagaaaggagtaggagatggcacagttagctggggtctagaagatgacgaagacatgacacttacaagatggacagggatgataattgggcctccaaga

SEQ ID NO: 3849 - DNA, 39 bp, Artificial Sequence
  iExon produced in gene TMEM214
ccatcctagatctgagatttgcaacctggaagttcaaga

SEQ ID NO: 3850 - DNA, 134 bp, Artificial Sequence
  iExon produced in gene TNS3
gcaggcccacccatgaaacatacacgacaccacagagacctccctgaaggtccctcaactgcatggacatgtagttcttccagccaagcagagggatcccggccaggtccccactgatccagtttgcaaaaaga

SEQ ID NO: 3851 - DNA, 34 bp, Artificial Sequence
  iExon produced in gene TOE1
gtttatggggaacaggtggtgtttggttaaatga

SEQ ID NO: 3852 - DNA, 76 bp, Artificial Sequence
  iExon produced in gene TRAF3
caccaatacattattatgaagtcagtacagagagattggcatcttagtattttctgaggaagagaacagccaaaga

SEQ ID NO: 3853 - DNA, 35 bp, Artificial Sequence
  iExon produced in gene TSPAN2
gttttgtggggaacaggtggtgtttggttacatga

SEQ ID NO: 3854 - DNA, 58 bp, Artificial Sequence
  iExon produced in gene TUBE1
agtggttggtgatggtggaagtatttccaagggaaaaatatgttctttaaaagcacga

SEQ ID NO: 3855 - DNA, 51 bp, Artificial Sequence
  iExon produced in gene TYW5
tgacagcatgaactgtcagaagctttgagttcaagcatcttgggagcaaga

SEQ ID NO: 3856 - DNA, 149 bp, Artificial Sequence; identical to SEQ ID NO: 3848
  iExon produced in gene UBE2V1

SEQ ID NO: 3857 - DNA, 80 bp, Artificial Sequence
  iExon produced in gene URGCP
gctttggggcagtggtcatttccgggaccaggccttttcattgccagctgactacccagcactttgagctcatgaataga

SEQ ID NO: 3858 - DNA, 111 bp, Artificial Sequence
  iExon produced in gene XRN2
gtggtttgaattgagaagggaagtatagcaaaagcttgagaaagccttaccgtctggagtttggactgtatcctataggcaatgagtagtcatgaaaatgatttgagagga

SEQ ID NO: 3859 - DNA, 54 bp, Artificial Sequence
  iExon produced in gene XRN2
ccatcaacaactcttagctgaaagagggataaggcccaagcaaggatagagaga

SEQ ID NO: 3860 - DNA, 40 bp, Artificial Sequence
  iExon produced in gene ZNF232
gtgagagactttgcctgtttcatcactcataaaattagga

SEQ ID NO: 3861 - DNA, 188 bp, Artificial Sequence
  iExon produced in gene ZNF680
gcagaactggccgtgaactgtggctcagggagctggaactgagtcatcgaactgcttcagaaaccacagtaaaggacaaggtctgcaggcctgcctgcgtggctataaatggctgtcttcctccaggcctctggaagggcacggtctctcccagactgtggctgggaggagtttgggatgattagaga

SEQ ID NO: 3862 - RNA, 10 nt, Artificial Sequence
  intronic recognition element for splicing modifier (REMS)
  misc_feature (1)..(2): n is a, c, g, or u
nngaguragu

SEQ ID NO: 3863 - DNA, 4 bp, Artificial Sequence
  intronic recognition element for splicing modifier (REMS)
  misc_feature (1)..(2): n is a, c, g, or t
nnga

SEQ ID NO: 3864 - DNA, 10 bp, Artificial Sequence
  intronic recognition element for splicing modifier (REMS)
  misc_feature (1)..(2): n is a, c, g, or t
nngagtragt

SEQ ID NO: 3865 - DNA, 8 bp, Artificial Sequence
  intronic recognition element for splicing modifier (REMS)
gagtragt

SEQ ID NO: 3866 - RNA, 8 nt, Artificial Sequence
  intronic recognition element for splicing modifier (REMS)
gaguragu
